United States Patent
Liu et al.

(10) Patent No.: US 11,685,954 B2
(45) Date of Patent: Jun. 27, 2023

(54) BIOMARKERS PREDICTIVE OF ENDOCRINE RESISTANCE IN BREAST CANCER

(71) Applicant: Dana-Farber Cancer Institute, Inc., Boston, MA (US)

(72) Inventors: Xiaole Liu, Wayland, MA (US); Myles Brown, Boston, MA (US); Wei Li, Boston, MA (US); Tengfei Xiao, Shanghai (CN)

(73) Assignee: Dana-Farber Cancer Institute, Inc., Boston, MA (US)

( * ) Notice: Subject to any disclaimer, the term of this patent is extended or adjusted under 35 U.S.C. 154(b) by 759 days.

(21) Appl. No.: 16/315,861

(22) PCT Filed: Jul. 10, 2017

(86) PCT No.: PCT/US2017/041335
§ 371 (c)(1),
(2) Date: Jan. 7, 2019

(87) PCT Pub. No.: WO2018/013466
PCT Pub. Date: Jan. 18, 2018

(65) Prior Publication Data
US 2019/0390280 A1  Dec. 26, 2019

Related U.S. Application Data

(60) Provisional application No. 62/363,029, filed on Jul. 15, 2016.

(51) Int. Cl.
| | | |
|---|---|---|
| *A61P 35/00* | (2006.01) | |
| *A61K 31/519* | (2006.01) | |
| *C12Q 1/6886* | (2018.01) | |
| *G01N 33/574* | (2006.01) | |

(52) U.S. Cl.
CPC ..... *C12Q 1/6886* (2013.01); *G01N 33/57415* (2013.01); *C12Q 2600/106* (2013.01)

(58) Field of Classification Search
CPC combination set(s) only.
See application file for complete search history.

(56) References Cited

U.S. PATENT DOCUMENTS

| | | | |
|---|---|---|---|
| 7,537,891 B2 | 5/2009 | Huang et al. | |
| 8,914,238 B2 | 12/2014 | Roder et al. | |
| 2011/0092388 A1 | 4/2011 | Lillie et al. | |
| 2014/0011695 A1 | 1/2014 | Lupien et al. | |

FOREIGN PATENT DOCUMENTS

| | | | |
|---|---|---|---|
| WO | WO 2013/067423 | * | 5/2013 |

OTHER PUBLICATIONS

Morgan et al (Cancer Biology & Therapy, 2009, 15:1550-1558).*
Anbalagan et al (PLoS ONE, 2012, 7:e33017).*
Elseberger et al (J Cancer Research Clinical Oncology, 2012, 138:327-332).*
Elsberger et al (The American Journal of Pathology, 2009, 175:1389-1397).*
Riggins et al (Cancer Letters, 2007, 256: 1-24).*
Vieda-Rodriguez et al (Oncology Reports 2014, 32:3-15).*
Holm et al Journal of the National Cancer Institute, 2006, 98:671-680).*
Ong et al (Breast Cancer Research, 2015, 17:59, internet pp. 1-12).*
Yeh et al (PLoS ONE, 2013, 8:e60889, p. 1-11).*
Miyoshi et al (Oncogenesis, 2015, 4:e172, pp. 1-9 and Supplementary Tables 4 and 5).*
Guest et al., "Src is a potential therapeutic target in endocrine-resistant breast cancer exhibiting low estrogen receptor-mediated transactivation," PLoS One, 11(6):1-15 (2016).
International Search Report and Written Opinion for International Application No. PCT/US2017/041335 dated Jan. 2, 2018.

* cited by examiner

*Primary Examiner* — Laura B Goddard
(74) *Attorney, Agent, or Firm* — Foley Hoag LLP; DeAnn F. Smith; Philip S. Choi

(57) ABSTRACT

The present invention is based on the identification of novel biomarkers predictive of endocrine resistance in breast cancer.

11 Claims, 42 Drawing Sheets
Specification includes a Sequence Listing.

D

E

F

A

B

C

D

E

A

B

C

A

B

C

D

E

F

D

A

B

C

D

E

A

B

C

D

B

A

B

A

B

A

B

A

B

E

A

B

A

B

C

A

B

C

A

B

BIOMARKERS PREDICTIVE OF ENDOCRINE RESISTANCE IN BREAST CANCER

CROSS-REFERENCE TO RELATED APPLICATIONS

This application is the U.S. national phase of International Patent Application No. PCT/US2017/041335, filed on 10 Jul. 2017, which claims the benefit of priority to U.S. Provisional Application No. 62/363,029, filed on 15 Jul. 2016; the entire contents of each of said applications are incorporated herein in their entirety by this reference.

STATEMENT OF RIGHTS

This invention was made with government support under grant number HG008728 awarded by The National Institutes of Health and W81XWH-15-1-0593 awarded by The Department of The Army. The government has certain rights in the invention.

BACKGROUND OF THE INVENTION

Oncogenic activation of the estrogen receptor (ER) signaling pathway occurs in over 70% of breast cancers (Musgrove et al. (2009) *Nat. Rev. Cancer* 9:631-643). This forms the basis of endocrine therapy that employs anti-estrogens and aromatase inhibitors for both breast cancer prevention and treatment (Howell (2008) *Best Pract. Res. Clin. Endocrinol. Metab.* 22:615-623). However, most patients with advanced disease eventually develop resistance to these endocrine therapies. For example, over 40% of ER+ breast cancer patients are resistant against endocrine therapy, a standard treatment for ER+ breast cancer. Previous experimental and clinical evidence implicated increased expression of ER and/or activated growth factor receptor signaling pathways, especially the EGFR/HER2 pathway, as major mechanisms of acquired resistance (Osborne et al. (2011) *Annu. Rev. Med.* 62:233-247; Fan et al. (2015) *Mol. Cell. Endocrinol.* 418 Pt 3:245-263). To date, how these oncogenic pathways are activated during endocrine therapy remains an open question. Accordingly, there is a great need to identify the mechanisms and biomarkers leading to endocrine resistance in breast cancer for developing improved diagnostic, prognostic, and therapeutic strategies.

SUMMARY OF THE INVENTION

The present invention is based, at least in part, on the discovery that certain biomarkers described herein predict clinical outcome in endocrine resistant breast cancer (e.g., ER+ breast cancer). Accordingly, the present invention relates, in part, to methods for stratifying patients who are predicted to be resistant to endocrine therapy based upon a determination and analysis of biomarkers described herein according to amount (e.g., copy number or level of expression) and/or activity, relative to a control. In addition, such analyses can be used in order to provide useful therapeutic regimens (e.g., based on predictions of clinical response, subject survival or relapse, timing of adjuvant or neoadjuvant treatment, etc.).

In one aspect, a method of identifying the likelihood of a breast cancer in a subject to be responsive to an endocrine therapy, the method comprising: a) obtaining or providing a sample from a patient having the breast cancer; b) measuring the presence, absence, amount, or activity of at least one biomarker listed in Table 1 or 2 in the subject sample; and c) comparing said presence, absence, amount, or activity of the at least one biomarker listed in Table 1 or 2 in a control sample, wherein the presence of the at least one biomarker listed in Table 1 or a significantly increased amount or activity of the at least one biomarker listed in Table 1, or the absence of the at least one biomarker listed in Table 2 or a significantly decreased amount or activity of the at least one biomarker listed in Table 2, in the subject sample relative to the control sample identifies the breast cancer as being more likely to be responsive to the endocrine therapy, and wherein the absence of the at least one biomarker listed in Table 1 or a significantly decreased amount or activity of the at least one biomarker listed in Table 1, or the presence of the at least one biomarker listed in Table 2 or a significantly increased amount or activity of the at least one biomarker listed in Table 2, in the subject sample relative to the control sample identifies the breast cancer as being less likely to be responsive to the endocrine therapy is provided.

In another aspect, a method of identifying the likelihood of a breast cancer in a subject to be responsive to an endocrine therapy, the method comprising: a) obtaining or providing a sample from a patient having the breast cancer, wherein the sample comprises nucleic acid molecules from the subject; b) determining the copy number of at least one biomarker listed in Table 1 or 2 in the sample; and c) comparing said copy number to that of a control sample, wherein an increased copy number of the at least one biomarker listed in Table for a decreased copy number of the at least one biomarker listed in Table 2 in the sample relative to the control sample identifies the breast cancer as being more likely to be responsive to the endocrine therapy, and wherein a decreased copy number of the at least one biomarker listed in Table 1 or an increased copy number of the at least one biomarker listed in Table 2 in the sample relative to the control sample identifies the breast cancer as being less likely to be responsive to the endocrine therapy is provided.

In one embodiment of any aspect of the present invention, the method further comprises recommending, prescribing, or administering endocrine therapy if the breast cancer is determined to be likely to be responsive to endocrine therapy. In another embodiment, the method further comprises recommending, prescribing, or administering non-endocrine therapy, or anti-cancer therapy other than endocrine therapy, if the breast cancer is determined be less likely to be responsive to endocrine therapy. In still another embodiment, the anti-cancer therapy is selected from the group consisting of targeted therapy, chemotherapy, radiation therapy, and/or hormonal therapy. In yet another embodiment, the non-endocrine therapy is a Src family kinase signaling pathway (SFKSP) inhibitor therapy. In yet another embodiment, the control sample is determined from a cancerous or non-cancerous sample from either the patient or a member of the same species to which the patient belongs. In another embodiment, the control sample comprises cells or does not comprise cells. In still another embodiment, the control sample comprises cancer cells known to be responsive or non-responsive to the endocrine therapy.

In still another aspect, a method of assessing the efficacy of an agent for treating a breast cancer that is unlikely to be responsive to endocrine therapy in a subject, comprising: a) detecting in a first subject sample and maintained in the presence of the agent the presence, absence, amount, or activity of at least one biomarker listed in Table 1 or 2; b) detecting the presence, absence, amount, or activity of the at least one biomarker listed in Table 1 or 2 in a second subject sample and maintained in the absence of the test compound; and c) comparing the presence, absence, amount, or activity of the at least one biomarker listed in Table 1 or 2 from steps a) and b), wherein a presence or a significantly increased amount or activity of the at least one biomarker listed in Table 1 or an absence or a significantly decreased amount or activity of the at least one biomarker listed in Table 2 in the first subject sample relative to at least one subsequent subject sample, indicates that the agent treats the breast cancer that is unlikely to be responsive to endocrine therapy in the subject is provided.

In yet another aspect, a method of assessing the efficacy of an agent for treating a breast cancer in a subject that is unlikely to be responsive to endocrine therapy, comprising: a) detecting in a subject sample at a first point in time the presence, absence, amount, or activity of at least one biomarker listed in Table 1 or 2; b) repeating step a) during at least one subsequent point in time after administration of the agent; and c) comparing the presence, absence, amount, or activity detected in steps a) and b), wherein a presence or a significantly increased amount or activity of the at least one biomarker listed in Table 2 or an absence or a significantly decreased amount or activity of the at least one biomarker listed in Table 1, in the first subject sample relative to at least one subsequent subject sample, indicates that the agent treats the breast cancer that is unlikely to be responsive to endocrine therapy in the subject is provided. In one embodiment, the first point in time and the subsequent point in time, the subject has undergone treatment, completed treatment, and/or is in remission for the cancer. In another embodiment, the first and/or at least one subsequent sample is selected from the group consisting of ex vivo and in vivo samples. In still another embodiment, the first and/or at least one subsequent sample is obtained from an animal model of the cancer. In yet another embodiment, the first and/or at least one subsequent sample is a portion of a single sample or pooled samples obtained from the subject.

In another aspect, a cell-based assay for screening for cytotoxic or cytostatic agents comprising contacting a breast cancer cell resistant to endocrine therapy with a test agent, and determining the ability of the test agent to increase the amount or activity of at least one biomarker listed in Table 1 and/or decrease the amount or activity of at least one biomarker listed in Table 2 is provided. In one embodiment, the step of contacting occurs in vivo, ex vivo, or in vitro.

In still another aspect, a cell-based assay for screening for agents that have a cytotoxic or cytostatic effect on a breast cancer cell resistant to endocrine therapy comprising, contacting the breast cancer cell with a test agent, and determining the ability of the test agent to increase the amount or activity of at least one biomarker listed in Table 1 and/or decrease the amount or activity of at least one biomarker listed in Table 2 is provided. In one embodiment, the step of contacting occurs in vivo, ex vivo, or in vitro.

In any aspect of the present invention, certain embodiments are contemplated. For example, in one embodiment of a method or assay described herein, the at least one biomarker listed in Table 1 comprises c-src tyrosine kinase (CSK) or an ortholog thereof. In another embodiment, the at least one biomarker listed in Table 1 comprises an mRNA or cDNA of the CSK. In still another embodiment, the at least one biomarker listed in Table 2 comprises p21 protein-activated kinase 2 (PAK2) or an ortholog thereof. In another embodiment, the at least one biomarker listed in Table 2 comprises proto-oncogene c (CRK) or an ortholog thereof. In still another embodiment, the subject sample is selected from the group consisting of whole blood, serum, plasma, urine, cells, cell lines, and biopsies. In yet another embodiment, the presence or amount of the at least one biomarker listed in Table 1 or 2 is detected using a reagent which specifically binds with the protein (e.g., a reagent is selected from the group consisting of an antibody, an antibody derivative, and an antibody fragment). In another embodiment, the presence or amount of the at least one biomarker listed in Table 1 is assessed by detecting the presence in the sample of a transcribed polynucleotide or portion thereof (e.g., an mRNA or a cDNA). In still another embodiment, the step of detecting further comprises amplifying the transcribed polynucleotide. In yet another embodiment, the transcribed polynucleotide is detected by identifying a nucleic acid that anneals with the biomarker nucleic acid, or a portion thereof, under stringent hybridization conditions.

In still another aspect, a method of treating a subject afflicted with a breast cancer that is resistant to an endocrine therapy comprising administering to the subject a therapeutically effective amount of at least one agent that activates or increases at least one biomarker listed in Table 1 and/or inhibits or blocks at least one biomarker listed in Table 2, thereby treating the subject afflicted with the breast cancer that is resistant to the endocrine therapy is provided. In one embodiment, the cancer is an estrogen receptor positive (ER+) breast cancer. In another embodiment, the agent directly binds the at least one biomarker listed in Tables 1 or 2.

In any aspect of the present invention described above, certain embodiments are contemplated. For example, in one embodiment of any method or assay, the at least one biomarker listed in Table 1 comprises CSK or an ortholog thereof. In another embodiment, the at least one biomarker listed in Table 1 comprises an mRNA or cDNA of the CSK. In still another embodiment, the at least one biomarker listed in Table 2 comprises PAK2 or an ortholog thereof. In yet another embodiment, the at least one biomarker listed in Table 1 comprises an mRNA or cDNA of PAK2. In another embodiment, the at least one biomarker listed in Table 2 comprises CRK or an ortholog thereof. In still another embodiment, the at least one biomarker listed in Table 1 comprises an mRNA or cDNA of PAK2. In yet another embodiment, the at least one agent comprises a small molecule that inhibits or blocks PAK2, such as FRAX597. In another embodiment, the at least one agent inhibits or blocks CRK. In still another embodiment, the at least one agent comprises an RNA interfering agent which inhibits expression of at least one biomarker listed in Table 2 (e.g., a small interfering RNA (siRNA), small hairpin RNA (shRNA), or a microRNA (miRNA)). In another embodiment, the at least one agent comprises an antisense oligonucleotide complementary to at least one biomarker listed in Table 2. In still another embodiment, the at least one agent comprises a peptide or peptidomimetic that inhibits or blocks at least one biomarker listed in Table 2. In yet another embodiment, the at least one agent comprises an aptamer that inhibits or blocks at least one biomarker listed in Table 2. In another embodiment, the at least one agent is an antibody and/or an intrabody, or an antigen binding fragment thereof, which specifically binds to at least one biomarker listed in Table 2. In still another embodiment, the antibody and/or intrabody, or antigen binding fragment thereof, that is murine, chimeric, humanized, composite, or human. In yet another embodiment, the antibody and/or intrabody, or antigen binding fragment thereof, is detectably labeled, comprises an effector domain, comprises an Fc domain, and/or is selected from the group consisting of Fv, Fav, F(ab')2, Fab', dsFv, scFv, sc(Fv)2, and diabodies fragments. In another embodiment, the antibody and/or intrabody, or antigen binding fragment thereof, is conjugated to a cytotoxic agent (e.g., a chemotherapeutic agent, a biologic agent, a toxin, and a radioactive isotope). In another embodiment, the at least one agent comprises a polypeptide molecule or peptide directed to at least one biomarker listed in Table 1. In still another embodiment, the at least one agent comprises an mRNA or cDNA of PAK. In yet another embodiment, the at least one agent reduces the number of proliferating cells in the cancer and/or reduces the volume or size of a tumor of the cancer. In yet another embodiment, the at least one agent is administered in a pharmaceutically acceptable formulation. In another embodiment, the method further comprises administering to the subject a therapeutic agent or regimen for treating the cancer.

In any aspect of the present invention, certain embodiments are contemplated. For example, in one embodiment of any method or assay, wherein the subject is an animal model of ER+ breast cancer. In another embodiment, the subject is a mammal, such as an mouse model of cancer, or a human.

Figure 1:
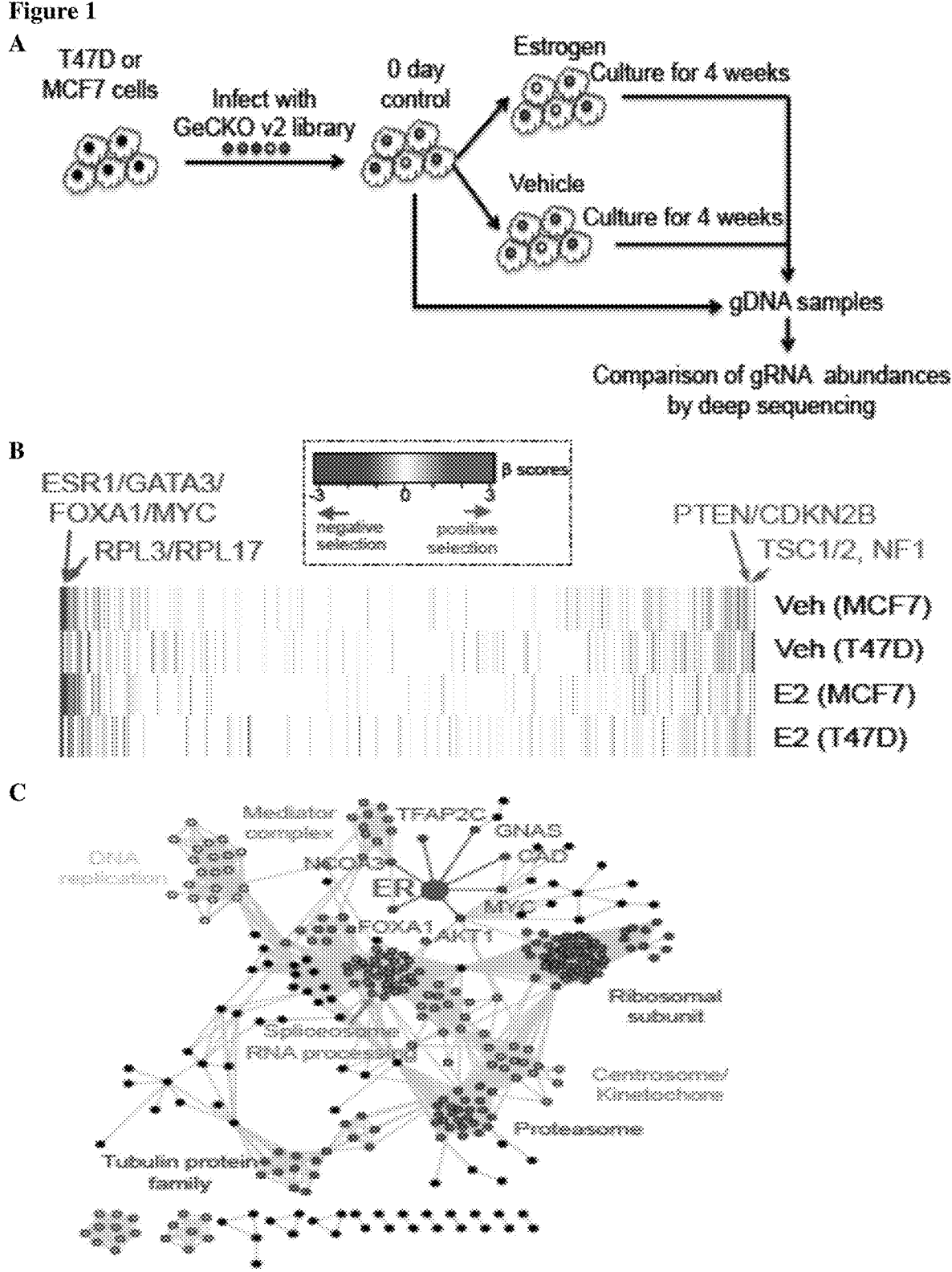
FIG. 1 includes 6 panels, identified as panels A, B, C, D, E, and F, which show CRISPR functional screens on two breast cancer cell lines, T47D and MCF7. Experimental procedures of the screening (Panel A). Positively selected (red) and negatively selected genes (blue) in T47D and MCF7 cells under E2 and veh treatments (Panel B). The positive (or negative) β values (calculated from the MAGeCK algorithm) indicate a positive (or negative) selection of a gene, respectively. A network view of top 1000 negatively selected genes in T47D and MCF7. In the network, nodes represent genes, and an edge connecting two genes if both are in the same pathway (Panel C). ER and its associated genes are highlighted in red, and some major gene clusters are also marked using different colors. The pathway information is extracted from GeneMANIA database (Warde-Farley et al. (2010) *Nucleic Acids Res.* 38:W214-20). 671 unconnected genes are now shown. Breast cancer specific essential genes in multiple cancer cell lines and cell types (Panel D). Screening data of cancer types other than breast cancer are collected from several public CRISPR screening experiments. The scores of breast cancer specific essential genes (Panel E). The names and ranks of some known breast cancer specific genes are marked. The expressions of breast cancer specific essential genes are significantly higher in breast cancer cell lines than other cell lines (Panel F). * $p<0.05$, Wilcox rank sum test.
Figure 1:
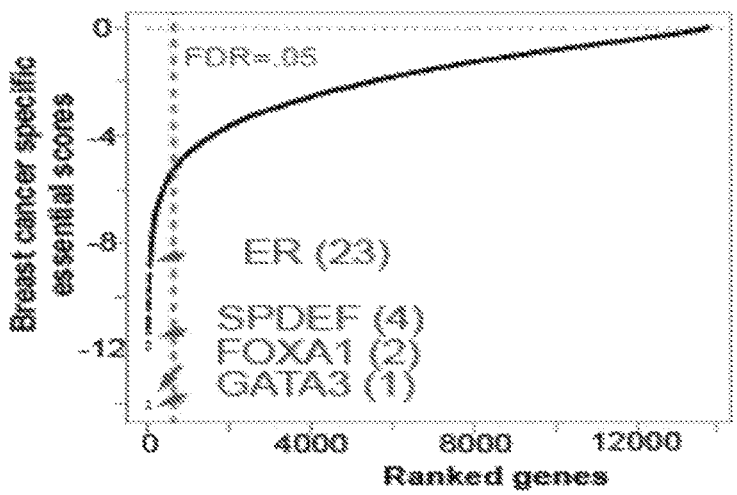
Figure 1:
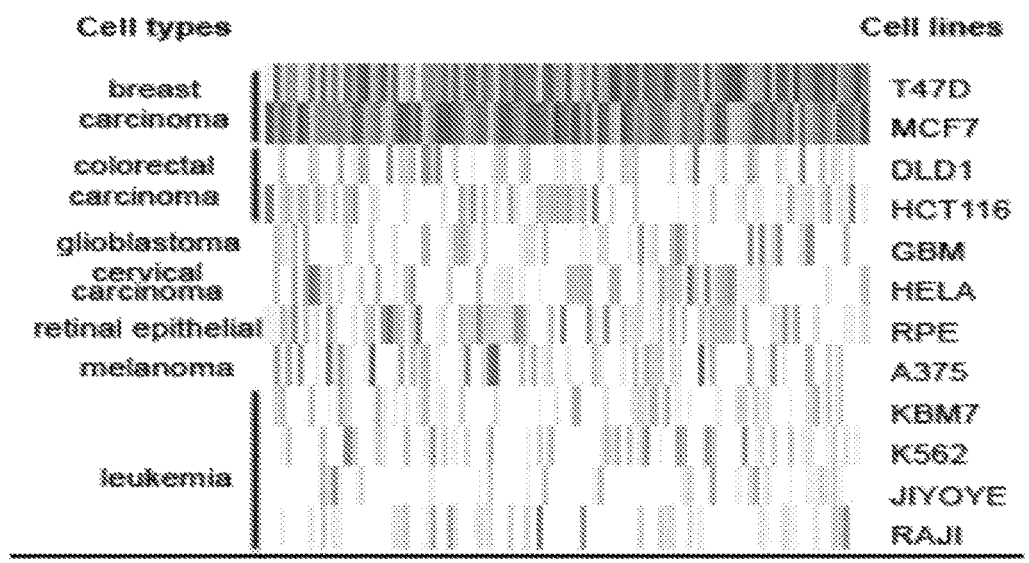
Figure 1:
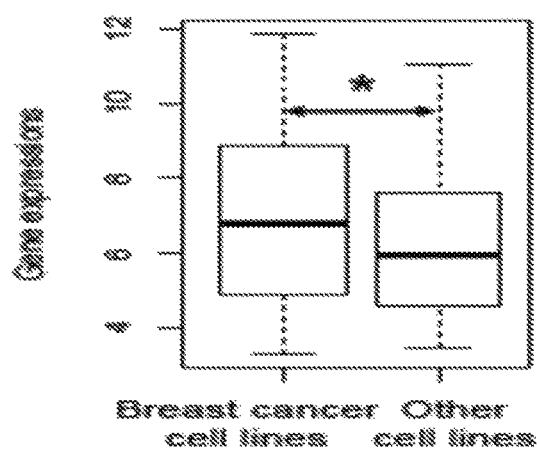

Note that for every figure containing a histogram, the bars from left to right for each discreet measurement correspond to the figure boxes from top to bottom in the figure legend as indicated.

DETAILED DESCRIPTION OF THE INVENTION

It has been determined herein that certain biomarkers described herein predict clinical outcome in endocrine resistant breast cancer (e.g., ER+ breast cancer). Accordingly, the present invention relates, in part, to methods for stratifying patients who are predicted to be resistant to endocrine therapy based upon a determination and analysis of biomarkers described herein according to amount (e.g., copy number or level of expression) and/or activity, relative to a control. In addition, such analyses can be used in order to provide useful therapeutic regimens (e.g., based on predictions of clinical response, subject survival or relapse, timing of adjuvant or neoadjuvant treatment, etc.).

I. Definitions

The articles "a" and "an" are used herein to refer to one or to more than one (i.e. to at least one) of the grammatical object of the article. By way of example, "an element" means one element or more than one element.

The term "altered amount" or "altered level" refers to increased or decreased copy number (e.g., germline and/or somatic) of a biomarker nucleic acid, e.g., increased or decreased expression level in a cancer sample, as compared to the expression level or copy number of the biomarker nucleic acid in a control sample. The term "altered amount" of a biomarker also includes an increased or decreased protein level of a biomarker protein in a sample, e.g., a cancer sample, as compared to the corresponding protein level in a normal, control sample. Furthermore, an altered amount of a biomarker protein may be determined by detecting posttranslational modification such as methylation status of the marker, which may affect the expression or activity of the biomarker protein.

The amount of a biomarker in a subject is "significantly" higher or lower than the normal amount of the biomarker, if the amount of the biomarker is greater or less, respectively, than the normal level by an amount greater than the standard error of the assay employed to assess amount, and preferably at least 20%, 30%, 40%, 50%, 60%, 70%, 80%, 90%, 100%, 150%, 200%, 300%, 350%, 400%, 500%, 600%, 700%, 800%, 900%, 1000% or than that amount. Alternately, the amount of the biomarker in the subject can be considered "significantly" higher or lower than the normal amount if the amount is at least about two, and preferably at least about three, four, or five times, higher or lower, respectively, than the normal amount of the biomarker. Such "significance" can also be applied to any other measured parameter described herein, such as for expression, inhibition, cytotoxicity, cell growth, and the like.

The term "altered level of expression" of a biomarker refers to an expression level or copy number of the biomarker in a test sample, e.g., a sample derived from a patient suffering from cancer, that is greater or less than the standard error of the assay employed to assess expression or copy number, and is preferably at least twice, and more preferably three, four, five or ten or more times the expression level or copy number of the biomarker in a control sample (e.g., sample from a healthy subjects not having the associated disease) and preferably, the average expression level or copy number of the biomarker in several control samples. The altered level of expression is greater or less than the standard error of the assay employed to assess expression or copy number, and is preferably at least 20%, 30%, 40%, 50%, 60%, 70%, 80%, 90%, 100%, 150%, 200%, 300%, 350%, 400%, 500%, 600%, 700%, 800%, 900%, 1000% or more times the expression level or copy number of the biomarker in a control sample (e.g., sample from a healthy subjects not having the associated disease) and preferably, the average expression level or copy number of the biomarker in several control samples.

The term "altered activity" of a biomarker refers to an activity of the biomarker which is increased or decreased in a disease state, e.g., in a cancer sample, as compared to the activity of the biomarker in a normal, control sample. Altered activity of the biomarker may be the result of, for example, altered expression of the biomarker, altered protein level of the biomarker, altered structure of the biomarker, or, e.g., an altered interaction with other proteins involved in the same or different pathway as the biomarker or altered interaction with transcriptional activators or inhibitors.

The term "altered structure" of a biomarker refers to the presence of mutations or allelic variants within a biomarker nucleic acid or protein, e.g., mutations which affect expression or activity of the biomarker nucleic acid or protein, as compared to the normal or wild-type gene or protein. For example, mutations include, but are not limited to substitutions, deletions, or addition mutations. Mutations may be present in the coding or non-coding region of the biomarker nucleic acid.

Unless otherwise specified here within, the terms "antibody" and "antibodies" broadly encompass naturally-occurring forms of antibodies (e.g. IgG, IgA, IgM, IgE) and recombinant antibodies such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

The term "antibody" as used herein also includes an "antigen-binding portion" of an antibody (or simply "antibody portion"). The term "antigen-binding portion", as used herein, refers to one or more fragments of an antibody that retain the ability to specifically bind to an antigen (e.g., a biomarker polypeptide or fragment thereof). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent polypeptides (known as single chain Fv (scFv); see e.g., Bird et al. (1988) *Science* 242:423-426; and Huston et al. (1988) *Proc. Natl. Acad. Sci. USA* 85:5879-5883; and Osbourn et al. 1998, Nature Biotechnology 16: 778). Such single chain antibodies are also intended to be encompassed within the term "antigen-binding portion" of an antibody. Any VH and VL sequences of specific scFv can be linked to human immunoglobulin constant region cDNA or genomic sequences, in order to generate expression vectors encoding complete IgG polypeptides or other isotypes. VH and VL can also be used in the generation of Fab, Fv or other fragments of immunoglobulins using either protein chemistry or recombinant DNA technology. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al. (1993) *Proc. Natl. Acad. Sci. USA* 90:6444-6448; Poljak, R. J., et al. (1994) *Structure* 2:1121-1123).

Still further, an antibody or antigen-binding portion thereof may be part of larger immunoadhesion polypeptides, formed by covalent or noncovalent association of the antibody or antibody portion with one or more other proteins or peptides. Examples of such immunoadhesion polypeptides include use of the streptavidin core region to make a tetrameric scFv polypeptide (Kipriyanov, S. M., et al. (1995) *Human Antibodies and Hybridomas* 6:93-101) and use of a cysteine residue, biomarker peptide and a C-terminal polyhistidine tag to make bivalent and biotinylated scFv polypeptides (Kipriyanov, S. M., et al. (1994) *Mol. Immunol.* 31:1047-1058). Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion polypeptides can be obtained using standard recombinant DNA techniques, as described herein.

Antibodies may be polyclonal or monoclonal; xenogeneic, allogeneic, or syngeneic; or modified forms thereof (e.g. humanized, chimeric, etc.). Antibodies may also be fully human. Preferably, antibodies of the present invention bind specifically or substantially specifically to a biomarker polypeptide or fragment thereof. The terms "monoclonal antibodies" and "monoclonal antibody composition", as used herein, refer to a population of antibody polypeptides that contain only one species of an antigen binding site capable of immunoreacting with a particular epitope of an antigen, whereas the term "polyclonal antibodies" and "polyclonal antibody composition" refer to a population of antibody polypeptides that contain multiple species of antigen binding sites capable of interacting with a particular antigen. A monoclonal antibody composition typically displays a single binding affinity for a particular antigen with which it immunoreacts.

Antibodies may also be "humanized", which is intended to include antibodies made by a non-human cell having variable and constant regions which have been altered to more closely resemble antibodies that would be made by a human cell. For example, by altering the non-human antibody amino acid sequence to incorporate amino acids found in human germline immunoglobulin sequences. The humanized antibodies of the present invention may include amino acid residues not encoded by human germline immunoglobulin sequences (e.g., mutations introduced by random or site-specific mutagenesis in vitro or by somatic mutation in vivo), for example in the CDRs. The term "humanized antibody", as used herein, also includes antibodies in which CDR sequences derived from the germline of another mammalian species, such as a mouse, have been grafted onto human framework sequences.

The term "assigned score" refers to the numerical value designated for each of the biomarkers after being measured in a patient sample. The assigned score correlates to the absence, presence or inferred amount of the biomarker in the sample. The assigned score can be generated manually (e.g., by visual inspection) or with the aid of instrumentation for image acquisition and analysis. In certain embodiments, the assigned score is determined by a qualitative assessment, for example, detection of a fluorescent readout on a graded scale, or quantitative assessment. In one embodiment, an "aggregate score," which refers to the combination of assigned scores from a plurality of measured biomarkers, is determined. In one embodiment the aggregate score is a summation of assigned scores. In another embodiment, combination of assigned scores involves performing mathematical operations on the assigned scores before combining them into an aggregate score. In certain, embodiments, the aggregate score is also referred to herein as the "predictive score."

The term "biomarker" refers to a measurable entity of the present invention that has been determined to be predictive of endocrine resistance therapy effects on a cancer. Biomarkers can include, without limitation, nucleic acids (e.g., genomic nucleic acids and/or transcribed nucleic acids) and proteins, including those shown in Tables 1 and 2, the Examples, and the Figures. Many biomarkers listed in Tables 1 and 2 are also useful as therapeutic targets. In one embodiment, such targets are CSK members shown in Table 1. In one embodiment, such targets are PAK2 and CRK members shown in Table 2.

A "blocking" antibody or an antibody "antagonist" is one which inhibits or reduces at least one biological activity of the antigen(s) it binds. In certain embodiments, the blocking antibodies or antagonist antibodies or fragments thereof described herein substantially or completely inhibit a given biological activity of the antigen(s).

The term "body fluid" refers to fluids that are excreted or secreted from the body as well as fluids that are normally not (e g amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit).

The terms "cancer" or "tumor" or "hyperproliferative" refer to the presence of cells possessing characteristics typical of cancer-causing cells, such as uncontrolled proliferation, immortality, metastatic potential, rapid growth and proliferation rate, and certain characteristic morphological features. In some embodiments, such cells exhibit such characteristics in part or in full due to the reduced expression, activity, and/or loss of CSK. Cancer cells are often in the form of a tumor, but such cells may exist alone within an animal, or may be a non-tumorigenic cancer cell, such as a leukemia cell. As used herein, the term "cancer" includes premalignant as well as malignant cancers. As used herein, the term "cancer" includes premalignant as well as malignant cancers. Cancers include, but are not limited to, B cell cancer, e.g., multiple myeloma, Waldenstrom's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematologic tissues, and the like. Other non-limiting examples of types of cancers applicable to the methods encompassed by the present invention include human sarcomas and carcinomas, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, colorectal cancer, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, liver cancer, choriocarcinoma, seminoma, embryonal carcinoma, Wilms' tumor, cervical cancer, bone cancer, brain tumor, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma; leukemias, e.g., acute lymphocytic leukemia and acute myelocytic leukemia (myeloblastic, promyelocytic, myelomonocytic, monocytic and erythroleukemia); chronic leukemia (chronic myelocytic (granulocytic) leukemia and chronic lymphocytic leukemia); and polycythemia vera, lymphoma (Hodgkin's disease and non-Hodgkin's disease), multiple myeloma, Waldenstrom's macroglobulinemia, and heavy chain disease. In some embodiments, cancers are epithlelial in nature and include but are not limited to, bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, Brenner, or undifferentiated.

Cancers that have grown into these structures or that have spread to distant lymph nodes or to other organs are considered unresectable, so treatments other than surgery are usually the best option.

The term "coding region" refers to regions of a nucleotide sequence comprising codons which are translated into amino acid residues, whereas the term "noncoding region" refers to regions of a nucleotide sequence that are not translated into amino acids (e.g., 5' and 3' untranslated regions).

The term "complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The term "control" refers to any reference standard suitable to provide a comparison to the expression products in the test sample. In one embodiment, the control comprises obtaining a "control sample" from which expression product levels are detected and compared to the expression product levels from the test sample. Such a control sample may comprise any suitable sample, including but not limited to a sample from a control cancer patient (can be stored sample or previous sample measurement) with a known outcome; normal tissue or cells isolated from a subject, such as a normal patient or the cancer patient, cultured primary cells/ tissues isolated from a subject such as a normal subject or the cancer patient, adjacent normal cells/tissues obtained from the same organ or body location of the cancer patient, a tissue or cell sample isolated from a normal subject, or a primary cells/tissues obtained from a depository. In another preferred embodiment, the control may comprise a reference standard expression product level from any suitable source, including but not limited to housekeeping genes, an expression product level range from normal tissue (or other previously analyzed control sample), a previously determined expression product level range within a test sample from a group of patients, or a set of patients with a certain outcome (for example, survival for one, two, three, four years, etc.) or receiving a certain treatment (for example, standard of care cancer therapy). It will be understood by those of skill in the art that such control samples and reference standard expression product levels can be used in combination as controls in the methods of the present invention. In one embodiment, the control may comprise normal or non-cancerous cell/ tissue sample. In another preferred embodiment, the control may comprise an expression level for a set of patients, such as a set of cancer patients, or for a set of cancer patients receiving a certain treatment, or for a set of patients with one outcome versus another outcome. In the former case, the specific expression product level of each patient can be assigned to a percentile level of expression, or expressed as either higher or lower than the mean or average of the reference standard expression level. In another preferred embodiment, the control may comprise normal cells, cells from patients treated with combination chemotherapy, and cells from patients having benign cancer. In another embodiment, the control may also comprise a measured value for example, average level of expression of a particular gene in a population compared to the level of expression of a housekeeping gene in the same population. Such a population may comprise normal subjects, cancer patients who have not undergone any treatment (i.e., treatment naive), cancer patients undergoing standard of care therapy, or patients having benign cancer. In another preferred embodiment, the control comprises a ratio transformation of expression product levels, including but not limited to determining a ratio of expression product levels of two genes in the test sample and comparing it to any suitable ratio of the same two genes in a reference standard; determining expression product levels of the two or more genes in the test sample and determining a difference in expression product levels in any suitable control; and determining expression product levels of the two or more genes in the test sample, normalizing their expression to expression of housekeeping genes in the test sample, and comparing to any suitable control. In particularly preferred embodiments, the control comprises a control sample which is of the same lineage and/or type as the test sample. In another embodiment, the control may comprise expression product levels grouped as percentiles within or based on a set of patient samples, such as all patients with cancer. In one embodiment a control expression product level is established wherein higher or lower levels of expression product relative to, for instance, a particular percentile, are used as the basis for predicting outcome. In another preferred embodiment, a control expression product level is established using expression product levels from cancer control patients with a known outcome, and the expression product levels from the test sample are compared to the control expression product level as the basis for predicting outcome. As demonstrated by the data below, the methods of the present invention are not limited to use of a specific cut-off point in comparing the level of expression product in the test sample to the control.

The "copy number" of a biomarker nucleic acid refers to the number of DNA sequences in a cell (e.g., germline and/or somatic) encoding a particular gene product. Generally, for a given gene, a mammal has two copies of each gene. The copy number can be increased, however, by gene amplification or duplication, or reduced by deletion. For example, germline copy number changes include changes at one or more genomic loci, wherein said one or more genomic loci are not accounted for by the number of copies in the normal complement of germline copies in a control (e.g., the normal copy number in germline DNA for the same species as that from which the specific germline DNA and corresponding copy number were determined). Somatic copy number changes include changes at one or more genomic loci, wherein said one or more genomic loci are not accounted for by the number of copies in germline DNA of a control (e.g., copy number in germline DNA for the same subject as that from which the somatic DNA and corresponding copy number were determined).

The "normal" copy number (e.g., germline and/or somatic) of a biomarker nucleic acid or "normal" level of expression of a biomarker nucleic acid or protein is the activity/level of expression or copy number in a biological sample, e.g., a sample containing tissue, whole blood, serum, plasma, buccal scrape, saliva, cerebrospinal fluid, urine, stool, and bone marrow, from a subject, e.g., a human, not afflicted with cancer, or from a corresponding non-cancerous tissue in the same subject who has cancer.

The term "determining a suitable treatment regimen for the subject" is taken to mean the determination of a treatment regimen (i.e., a single therapy or a combination of different therapies that are used for the prevention and/or treatment of the cancer in the subject) for a subject that is started, modified and/or ended based or essentially based or at least partially based on the results of the analysis according to the present invention. One example is determining whether to provide targeted therapy against a cancer to provide immunotherapy that generally increases immune responses against the cancer. Another example is starting an adjuvant therapy after surgery whose purpose is to decrease the risk of recurrence, another would be to modify the dosage of a particular chemotherapy. The determination can, in addition to the results of the analysis according to the present invention, be based on personal characteristics of the subject to be treated. In most cases, the actual determination of the suitable treatment regimen for the subject will be performed by the attending physician or doctor.

The term "diagnosing cancer" includes the use of the methods, systems, and code of the present invention to determine the presence or absence of a cancer or subtype thereof in an individual. The term also includes methods, systems, and code for assessing the level of disease activity in an individual.

In some embodiments, the cancer is "estrogen positive breast cancer" or "(ER+) breast cancer," which refers to breast cancers that are estrogen receptor (ER) positive. Breast cancer is the most common cancer affecting women and accounts for 26% of newly diagnosed cancers (Cecchini et al. (2015) *Cureus* 7(10):e364). Of these cancers, over 80% will express either the estrogen or progesterone receptor and be amenable to hormonal therapy (Howlader et al. (2014) *J Natl Cancer Inst.* 106). The use of aromatase inhibitors, anti-estrogens, tamoxifen, or fulvestrant is associated with a significant reduction in breast cancer recurrence and improved overall survival (Davies et al. (2011) *Lancet* 378:771-784). However, most patients with advanced disease eventually develop resistance to these therapies. Breast-conserving surgery has been shown to have equivalent outcomes to mastectomy when combined with radiation therapy and has become the main treatment method for breast cancer patients (Clarke et al. (2005) *Lancet* 366:2087-2106). Thereby, there are a substantial number of women who receive radiation and hormonal therapy.

Estradiol activates proliferation through transcriptional activation of c-Myc and cyclin D, which allow for downstream activation of the cyclin-dependent kinases required for progression from G1 into S phase of the cell cycle (Schmidberger et al. (2003) *Endocr Relat Cancer* 10:375-388). This activity of estrogen is required for the proliferation of the cancer cells; tamoxifen or aromatase inhibitors are utilized to block this pathway (Schmidberger et al. (2003) *Endocr Relat Cancer* 10:375-388). Treatment of cells with tamoxifen or aromatase inhibitors results in an accumulation of cells in the G1 phase of the cell cycle. Radiation sensitivity depends on the stage of the cell cycle, with cells in G2/M being the most sensitive to radiation changes (Sinclair et al. (1966) *Radiat Res.* 29:450-474). Therefore, it is possible that hormonal therapy may reduce the efficacy of radiation by arresting the cells in a stage of the cell cycle that is more resistant to DNA damage.

As used herein, "endocrine therapies" are first-line treatments for estrogen receptor-positive (ER+) breast cancer, such as selective ER modulation using tamoxifen or anti-estrogens, aromatase inhibitors, nonsteroidal drugs (e.g., letrozol, anastrozol, and vostrozol), steroidal drugs (e.g., exemestane), ovarian ablation surgery, ovarian ablation radiotherapy, LHRH analog therapy, anti-HER-2 antibodies, anti-ER antibodies, anti-PR antibodies, and the like. Representative endocrine therapies are further described below (see US2007/0192880). Although complementation and convergence of various signaling pathways are ultimately responsible for the physiology and pathophysiology of breast tissue, it is clear that estrogens are primary agents in the development of most breast cancers by stimulating and maintaining malignant cell proliferation. Consequently, measures that perturb the estrogen environment of the tumor cells by blocking the synthesis of estrogen or by preventing estrogen actions are current strategies for therapeutic intervention for the neoplasm. The management of early breast cancer is primarily based on surgical removal of the tumor by mastectomy or lumpectomy without or with radiotherapy, followed by an adjuvant systemic therapy dependent upon the ER status.

(1) GnRH Antagonist

GnRH regulates the synthesis and secretion of LH and FSH from the anterior pituitary (Shalev, E. et al. (2003) *J Obstet Gynaecol Can* 25, 98-113). GnRH-stimulated gonadotropin secretion can be blocked with antagonists as well as agonists whose sustained delivery induces pituitary desensitization (Limonta, P. et al. (2001) *Expert Opin Investig Drugs* 10, 709-720). These compounds ultimately reduce the circulating levels of gonadotropins and subsequently gonadal steroid hormone synthesis and secretion. Termed medical castration, this effect is exploited in the treatments of sex hormone-dependent neoplasms that also include breast (Robertson, J. F. et al. (2003) *Eur. J. Cancer* 39, 861-869; Grundker, C. et al. (2003) *Reprod Biol Endocrinol* 1, 65). The GnRH agonist, goserelin, remains the treatment of choice for pre-menopausal patients with ER-positive breast cancers. It appears that a combination of goserelin and antiestrogenic compounds to produce an estrogen blockade is a more effective treatment regimen in prolonging progression-free survival than the use of a GnRH agonist alone (Robertson, J. F. et al. (2003) *Eur. J. Cancer* 39, 861-869; Grundker, C. et al. (2003) *Reprod Biol Endocrinol* 1, 65).

(2) Aromatase Inhibitors Since, as described above, estrogens are synthesized from androgenic steroid substrates by the aromatase enzyme, an effective perturbation of enzyme activity provides the most specific effects on estrogen production. Two major classes of aromatase inhibitors have been developed and are currently in clinical use. Type 1 inhibitors are steroidal analogues of androstenedione and bind to the same site as androstenedione on the aromatase molecule. However, unlike androstenedione these analogues bind to the enzyme irreversibly and covalently, because of their conversion to reactive intermediates by aromatase (Simpson, E. R. et al. (2002) *Recent Prog. Horm. Res.* 57, 317-338; Santen, R. J. (2002) *J. Clin. Endocrinol. Metab.* 87, 3007-3012). Therefore, Type 1 inhibitors are now commonly known as enzyme inactivators that include formestane and exemestane. Since the recovery of enzyme activity depends on both the re-synthesis of enzyme and the pharmacokinetics of the drug, these types of inhibitors have the potential for selectivity for the enzyme target and long-term effectiveness. However, such steroidal structures also have the potential for hormonal activity (Simpson, E. R. et al. (2002) *Recent Prog. Horm. Res.* 57, 317-338; Santen, R. J. (2002) *J. Clin. Endocrinol. Metab.* 87, 3007-3012).

Type II inhibitors are non-steroidal compounds that are triazoles and include anastrozole and letrozole. These type II inhibitors bind reversibly to the enzyme and fit into the substrate-binding site such that azole nitrogens interact with the heme prosthetic group in the aromatase enzyme with high affinity and specificity (Simpson, E. R. et al. (2002) *Recent Prog. Horm. Res.* 57, 317-338; Santen, R. J. (2002) *J. Clin. Endocrinol. Metab.* 87, 3007-3012).

Aromatase inhibitors are not effective in pre-menopausal women, as lower circulating levels of estrogen could result in the stimulation of the hypothalamo-hypophyseal axis activity, which in turn increases circulating estrogen levels by enhancing estrogen synthesis from the ovaries (Simpson, E. R. et al. (2002) *Recent Prog. Horm. Res.* 57, 317-338; Santen, R. J. (2002) *J. Clin. Endocrinol. Metab.* 87, 3007-3012). Thus, application of aromatase inhibitors to treatment of pre-menopausal women with breast cancer is limited to their combined usage with goserelin. Since, however, the primary source of estrogen in post-menopausal women is the conversion of adrenal C19 steroids into estrogens by intra-tumor as well as extra-gonadal sites of aromatase activity, aromatase inhibitors constitute an effective therapeutic intervention for breast cancers (Simpson, E. R. et al. (2002) *Recent Prog. Horm. Res.* 57, 317-338; Santen, R. J. (2002) *J. Clin. Endocrinol. Metab.* 87, 3007-3012). Studies indicate that aromatase inhibitor therapy leads to a precipitous drop in the intratumoral concentrations of estrogens together with a corresponding loss of intratumoral aromatase activity (Simpson, E. R. et al. (2002) *Recent Prog. Horm. Res.* 57, 317-338; Santen, R. J. (2002) J. Clin. Endocrinol. Metab. 87, 3007-3012). Clinical trials have provided further support for the use of the aromatase inhibitors as first line treatment of ER positive breast cancers in post-menopausal women (Simpson, E. R. et al. (2002) *Recent Prog. Horm. Res.* 57, 317-338; Santen, R. J. (2002) *J. Clin. Endocrinol. Metab.* 87, 3007-3012). Since, however, aromatase inhibitors inhibit aromatase activity globally, these compounds could affect many other tissues wherein estrogens are required for normal function. The development of tissue-specific aromatase inhibitors could expand the utility of this approach in the treatment of breast cancers (Simpson, E. R. et al. (2002) *Recent Prog. Horm. Res.* 57, 317-338; Santen, R. J. (2002) *J. Clin. Endocrinol. Metab.* 87, 3007-3012).

(3) Antiestrogens

In addition to estrogen, ER also binds compounds that act as estrogen competitors (McDonnell, D. P. (1999) *Trends Endocrinol Metab* 10, 301-311; Jordan, V. C. et al. (1999) *Endocr. Rev.* 20, 253-278; Jensen, E. V. et al. (2003) *Clin Cancer Res* 9, 1980-1989). These compounds can be divided into two categories: Type I and II. Type I compounds include tamoxifen, toremifene and raloxifene and are now referred to as selective estrogen receptor modulators, SERMs. Tamoxifen and toremifene have a triphenylethylene structure and raloxifene has a benzothiophene structure. Although the primary structure of these SERMs differs significantly from that of estrogen which is a cyclophenanthrene, they have conformations that allow them to bind to ERs. SERMs can function as agonists or antagonists depending on ER subtypes, and the cells and tissues in which they operate (McDonnell, D. P. (1999) *Trends Endocrinol Metab* 10, 301-311; Wakeling, A. E. (2000) *Endocr Relat Cancer* 7, 17-28). Tamoxifen and raloxifene function as antagonists in breast. While tamoxifen acts as an agonist in the uterus, bone and cardiovascular system, raloxifene functions as a pure antagonist in the uterus but an agonist in bone.

Type II compounds that include steroidal compounds ICI 164,384 and ICI 182,780 are derivatives of estrogen with long alkyl 7α-substitutions and are considered as pure antagonists devoid of estrogenic activity in most experimental systems tested (McDonnell, D. P. (1999) *Trends Endocrinol Metab* 10, 301-311; Wakeling, A. E. et al. (2001) *Clin Cancer Res* 7, 4350s-4355s; discussion 4411s-4412s). The distinct pharmacological properties of these antiestrogens allow treatment regimens to be targeted to a specific tissue of interest to minimize unintended development of other tissue malignancies.

Biochemical, functional and structural studies have indicated that antiestrogens alter the conformation of the carboxyl-terminal regions of ERs (McDonnell, D. P. (1999) *Trends Endocrinol Metab* 10, 301-311; Wakeling, A. E. et al. (2001) *Clin Cancer Res* 7, 4350s-4355s; discussion 4411s-4412s). Ligand binding is accompanied by a major reorganization in the tertiary structure of the LBD. Key differences in receptor conformation in the presence of different ligands are an indication for a structural basis for antagonism. Agonist binding induces a conformational change in which the carboxyl terminal helix 12 (H12), containing the core region of AF2, is aligned over the ligand-binding cavity that is composed of helices 3, 5/6, and 11. This alignment results in the formation of a specific binding site for the consensus LXXLL motif of co-activators. Binding of the Type 1 antagonists to ER sterically interferes with H12 positioning in that H12 interacts with a hydrophobic groove composed of residues from helices 3 and 5. This distinct orientation of H12 partially buries residues in the groove necessary for AF-2 activity, thereby preventing co-factor recruitment (Brzozowski, A. M. et al. (1997) *Nature* 389, 753-758; Pike, A. C. et al. (1999) *EMBO J.* 18, 4608-4618).

In ICI-bound ER, the side chain of ICI completely prevents H12 from associating with the LBD. This disordered conformation is thought to lead to full antagonism that results in the destabilized ER structure leading to disruption of nuclear-cytoplasmic shuttling and increased receptor turnover (Dauvois, S. et al. (1992) *Proc Natl Acad Sci USA* 89, 4037-4041; Dauvois, S. et al. (1993) *J. Cell Sci.* 106 (Pt 4), 1377-1388). ICI 182,780 (Faslodex) is approved as a "second-line" hormonal therapy for post-menopausal women with ER-positive metastatic breast cancer (Howell, A. et al. (2000) *Cancer* 89, 817-825).

Although blocking the AF-2 function by antagonists suggests a passive role for the prevention of ER-mediated transactivation by antiestrogens, an active repression of gene transcription appears to be involved. Tamoxifen-ER is shown to recruit the co-repressors NCoR, SMRT (Lavinsky, R. M. et al. (1998) *Proc. Natl. Acad. Sci. USA* 95, 2920-2925; Shang, Y. et al. (2000) *Cell* 103, 843-852) and REA (Delage-Mourroux, R. et al. (2000) *J. Biol. Chem.* 275, 35848-35856) to the promoters of estrogen responsive genes. The subsequent recruitment of histone deacetylases (HDACs) to the repressor-ER complex causes deacetylation of histone proteins. This event leads to chromatin compaction and transcriptional repression.

How does a SERM display partial agonist activity in an ER subtype and cell context dependent manner? The partial agonist activity of an antagonist is manifested as transcriptional responses from ERE-dependent genomic signaling pathway that are siginficantly lower than those observed with the estrogen-ER complex. The partial agonistic effect of SERMs, particularly tamoxifen, bound ERα, but not ERβ, from the ERE-dependent signaling pathway is modulated through the amino terminal AF-1 (Berry, M. et al. (1990) *EMBO J.* 9, 2811-2818; Yi, P. et al. (2002) *Mol. Endocrinol.* 16, 1810-1827). It appears that although the binding of a SERM to ERα prevents the AF-2 domain of the receptor from interacting with co-factors, the ability of the AF-1 domain to recruit the p160 family of co-factors in a cell-context dependent manner provides a mechanism for the partial agonistic effect of an antagonist for ERα (Yi, P. et al. (2002) *Mol. Endocrinol.* 16, 1810-1827; Webb, P. et al. (1998) *Mol. Endocrinol.* 12, 1605-1618; Yi, P. et al. (2002) *Mol. Endocrinol.* 16, 674-693). Studies have shown that the tamoxifen-bound ERα recruits co-repressors, but not co-activators, to target promoters in breast cancer cells (Lavinsky, R. M. et al. (1998) *Proc. Natl. Acad. Sci. USA* 95, 2920-2925; Shang, Y. et al. (2000) *Cell* 103, 843-852; Shang, Y. et al. (2002) *Science* 295, 2465-2468; Lee, E. J. et al. (2001) *Mol. Med.* 7, 773-782). On the other hand, the tamoxifen-ERα complex interacts preferentially with the p160 family co-activators as well as co-repressors to target promoters to stimulate transcription in cells derived from endometrium (Shang, Y. et al. (2002) *Science* 295, 2465-2468). This allows the tamoxifen-ERα complex to induce transcription, albeit at lower levels than estrogen-ERα, from estrogen responsive genes. Since the relative and absolute levels of expression of co-regulators vary among estrogen target cells, a balance between cell specific co-activators and co-repressors recruited by the antagonist-ERα complex appears to underlie the tissue selective pharmacology of SERMs (Shang, Y. et al. (2002) *Science* 295, 2465-2468; McKenna, N. J. et al. (1999) *Endocr. Rev.* 20, 321-344).

It should be noted that antiestrogens could also affect the function of intracellular proteins and signaling independently from ER signaling pathways. These include changes in oxidative stress responses, activation of specific protein kinase C isoforms as well as alterations in calmodulin function and in cell membrane structure/function (Clarke, R. et al. (2001) *Pharmacol. Rev.* 53, 25-71).

As used herein, "endocrine resistant" refers to patients who initially respond to endocrine therapies but later become unresponsive to endocrine therapies. Current therapeutic approaches for breast cancer treatment utilize endocrine measures to counteract the effects of estrogens and are often successful in the remission of tumors (Nicholson, R. I. et al. (2000) *Br. J. Cancer* 82, 501-513; Clarke, R. et al. (2001) *J. Steroid Biochem. Mol. Biol.* 76, 71-84; Nicholson, R. I. et al. (2003) *Breast Cancer Res. Treat.* 80 Suppl 1, S29-34; Clarke, R. et al. (2003) *Oncogene* 22, 7316-7339). However, one-third of breast cancers fails to respond to endocrine therapy (de novo endocrine resistance). Moreover, the beneficial effects of antiestrogens are counteracted by the capacity of tumor cells to eventually circumvent such therapies, allowing the tumor cells to resume growth (acquired endocrine resistance).

(1) De Novo Endocrine Resistance

The most important factor in de novo resistance to endocrine therapies is the lack of ER expression. However, the ontology of de novo endocrine resistance cells is unclear. These populations could stem from ERα-negative epithelial cells that acquire autonomous growth properties. It is also possible that mitogenic changes in non-proliferate and ERα positive epithelial cells give rise to a phenotype that gains autonomous growth but loses its ability to express the ERα gene. Although the status of the ERβ gene expression remains unknown in de novo resistant phenotypes, genetic alterations such as homozygous deletion, loss of heterozygosity or ERα gene mutation have not been reported to play a major role in the absence or loss of ER expression. Epigenetic control of ERα gene expression, on the other hand, appears to be critical for the absence/loss of the ERα gene transcription. CpG dinucleotides are frequently clustered into CpG islands and are often found in the promoters of genes (Chen, D. et al. (1999) *Science* 284, 2174-2177; Yang, X. et al. (2001) *Endocr Relat Cancer* 8, 115-127). Methylation of cytosines in these islands is associated with the repression of gene transcription (Chen, D. et al. (1999) *Science* 284, 2174-2177; Yang, X. et al. (2001) *Endocr Relat Cancer* 8, 115-127). Studies have indicated that the ERα gene contains CpG islands in its promoter and first exon (Falette, N. S. et al. (1990) *Cancer Res.* 50, 3974-3978; Ottaviano, Y. L. et al. (1994) *Cancer Res.* 54, 2552-2555).

These ERα CpG islands are unmethylated in normal breast tissue and ERα-positive tumor lines but they are methylated in about half of primary breast cancers and most ER-negative breast cancer cell lines (Ottaviano, Y. L. et al. (1994) *Cancer Res.* 54, 2552-2555; Piva, R. et al. (1989) *Biochemistry International* 19, 267-275). The methylation status of CpG islands is associated with reduced or absent ERα expression, consequently cessation of ER protein synthesis (Ottaviano, Y. L. et al. (1994) *Cancer Res.* 54, 2552-2555; Piva, R. et al. (1989) *Biochemistry International* 19, 267-275). DNA methylation is regulated by the members of DNA-cytosine methyltransferase (DNMT) family (Chen, D. et al. (1999) *Science* 284, 2174-2177; Yang, X. et al. (2001) *Endocr Relat Cancer* 8, 115-127). Studies have shown that methyltransferase inhibitors cause partial de-methylation and restoration of ERα mRNA expression and synthesis of functional ERα protein (Ferguson, A. T. et al. (1995) *Cancer Res.* 55, 2279-2283). A disregulated expression of DNMT in ERα-negative breast cancer cell lines is proposed to be associated with the ER-gene repression (Yang, X. et al. (2001) *Endocr Relat Cancer* 8, 115-127).

Methylation of the ERα gene is required but may not be sufficient for ERα gene repression. It appears that the acetylation status of the ERα gene also contributes to ERα gene silencing (Yang, X. et al. (2000) *Cancer Res.* 60, 6890-6894). Studies showed that an increase in the acetylation of histones and de-methylation of the ER CpG islands synergistically activate ERα expression (Yang, X. et al. (2001) *Cancer Res.* 61, 7025-7029). This suggests that DNMT and HDAC are key regulators of methylation-mediated ERα gene silencing. These findings also imply that DNMT and HDAC inhibitors could be potentially important in establishing hormone responsiveness, and consequently in breast cancer treatment.

The underlying mechanisms for the methylation and acetylation status of the ERα gene promoter are unclear. Studies showed that the activation of the growth factor signaling pathways in breast cancer cells results in down-regulation of ERα gene expression (Pietras, R. J. et al. (1995) *Oncogene* 10, 2435-2446; Kumar, R. et al. (1996) *J. Cell. Biochem.* 62, 102-112; Tang, C. K. et al. (1996) *Cancer Res.* 56, 3350-3358) through, at least in part, an enhanced deacetylase activity (Mazumdar, A. et al. (2001) *Nat Cell Biol* 3, 30-37). It is therefore possible that aberrant growth factor signaling is involved in the absence or loss of ER gene expression. Additionally, altered expression of transacting factors responsible for ERα transcription and/or abnormalities in post-transcriptional and translational processing of ERα could also contribute to the absence of ER synthesis (Weigel, R. J. et al. (1993) *Cancer Res.* 53, 3472-3474; Ferguson, A. T. et al. (1997) *Crit. Rev. Oncog.* 8, 29-46; Ferguson, A. T. et al. (1998) *Cancer Treat. Res.* 94, 255-278).

Whatever the underlying mechanisms for the absence or loss of the ERα gene expression might be, an autonomous regulation of cell growth defines de novo resistance malignancies. Several growth factors and their receptors that include EGF, FGF, IGF, and TGF families have been shown to be over-expressed and to act as autocrine growth stimulators for breast cancer cells (Nicholson, R. I. et al. (2000) *Br. J. Cancer* 82, 501-513; Clarke, R. et al. (2001) *J. Steroid Biochem. Mol. Biol.* 76, 71-84; Clarke, R. et al. (2003) *Oncogene* 22, 7316-7339). Increased expression of growth factor receptors correlates with the severity of the disease (Nicholson, R. I. et al. (2000) *Br. J. Cancer* 82, 501-513; Clarke, R. et al. (2001) *J. Steroid Biochem. Mol. Biol.* 76, 71-84; Clarke, R. et al. (2003) *Oncogene* 22, 7316-7339).

Receptors for growth factors are trans-membrane tyrosine kinases that are linked to activation of MAPK and/or AKT signaling pathways critical for cellular transformation, cancer progression and resistance to endocrine therapy (Nicholson, R. I. et al. (2000) Br. J. Cancer 82, 501-513; Clarke, R. et al. (2001) J. Steroid Biochem. Mol. Biol. 76, 71-84; Clarke, R. et al. (2003) Oncogene 22, 7316-7339). Disrupting signal transduction by specifically modulating the activity of these trans-membrane tyrosine kinases, therefore, constitutes an important strategy in the development anti-cancer agents. This includes antibody therapy to block ligand binding to the receptors and administration of small molecule tyrosine kinase inhibitors to inhibit receptor tyrosine kinase activity.

The EGFR belongs to a family of tyrosine kinases that contains human epidermal growth factor receptor-1 (or HER1), HER2, HER3, and HER4 (Yarden, Y. (2001) Oncology 61 Suppl 2, 1-13). Receptor activation is mediated by homo- and heterodimerization among all four HER family members upon binding to various ligands. Dimerization results in receptor tyrosine phosphorylation that allows the binding of downstream signaling molecules leading to the activation of kinases. Heterodimerization of HERs provides further diversification and specificity of signal transduction. Moreover, many other growth factor receptors can phosphorylate and activate HERs. HERs also act as a conduit for multiple other signaling pathways through trans-phosphorylation. HER2 is over-expressed in approximately 30% of breast cancers with adverse clinical prognosis (Slamon, D. J. et al. (1989) Science 244, 707-712). Trastuzumab is a novel humanized monoclonal antibody that binds to the extracellular domain of HER2 (Modi, S. et al. (2002) Curr Oncol Rep 4, 47-55). This leads to receptor down-regulation, degradation and consequently to inhibition of cell growth. Trastuzumab is currently being used in clinical settings for the treatment of patients with HER2-positive metastatic breast cancer with significant benefits as monotherapy or in combination with chemotherapy (Vogel, C. L. et al. (2002) J. Clin. Oncol. 20, 719-726; Slamon, D. J. et al. (2001) N. Engl. J. Med. 344, 783-792). Similarly, a humanized monoclonal antibody BX-EGF that targets the extracellular domain of HER1 has entered clinical trials for breast cancer treatments (Modi, S. et al. (2002) Curr Oncol Rep 4, 47-55).

Small molecule compounds compete for the ATP-binding sites of the tyrosine kinase domains of the HER-family Binding of these compounds to the receptor block the activation of the tyrosine kinase domain and subsequently prevent the downstream signaling cascades that include MAPK and AKT pathways (Modi, S. et al. (2002) Curr Oncol Rep 4, 47-55; Arteaga, C. L. et al. (2002) Semin. Oncol. 29, 4-10; Goel, S. et al. (2002) Curr Oncol Rep 4, 9-19). The two most clinically advanced compounds in this class of agents are ZD1839 and OSI-774 that specifically target HER1, whereas CI-1033 interacts with all four members of the HER-family. In pre-clinical models ZD1839 displays anti-proliferative activity by interfering with cell cycle progression in a wide range of HER-expressing cancer cell lines (Sliwkowski, M. X. et al. (1999) Semin. Oncol. 26, 60-70). ZD1839 also augments the antitumor effects of chemo- and radiation-therapies (Modi, S. et al. (2002) Curr Oncol Rep 4, 47-55; Arteaga, C. L. et al. (2002) Semin. Oncol. 29, 4-10; Goel, S. et al. (2002) Curr Oncol Rep 4, 9-19). However, recent clinical trials in patients with refractory metastatic breast cancer, suggest that EGFR inhibitor ZD1839 has no clinical activity (Arteaga, C. L. et al. (2004) Semin. Oncol. 31, 3-8). Pharmacodynamic studies (Arteaga, C. L. et al. (2004) Semin. Oncol. 31, 3-8) also indicate that the activated EGFR in breast tumor cells is indeed blocked by EGFR tyrosine kinase inhibitors but without an associated reduction in tumor cell proliferation. These results imply that 1) levels of P-EGFR do not predict for EGFR dependence nor sensitivity to therapeutic EGFR blockade, and 2) drug-induced inhibition of P-EGFR is not predictive of response to treatment either.

(2) Acquired Endocrine Resistance

Counteraction of the beneficial effects of endocrine approaches by the tumor cells that express ER leads to acquired endocrine resistance phenotypes, in which the cells are no longer growth inhibited by antiestrogens (Nicholson, R. I. et al. (2000) Br. J. Cancer 82, 501-513; Clarke, R. et al. (2001) J. Steroid Biochem. Mol. Biol. 76, 71-84; Nicholson, R. I. et al. (2003) Breast Cancer Res. Treat. 80 Suppl 1, S29-34; Clarke, R. et al. (2003) Oncogene 22, 7316-7339). It is certain that endocrine resistance is multi-factorial. Since breast cancers display a remarkable phenotypic heterogeneity as a result of distinct gene expression profiles (Perou, C. M. et al. (2000) Nature 406, 747-752; Sorlie, T. et al. (2001) Proc Natl Acad Sci USA 98, 10869-10874), each cancer type likely utilizes a different resistance mechanism. Nonetheless, aberrations in ER signaling pathways appear to be critical events that drive the response and resistance to antiestrogens. A rise in the population of ER mutants as ligand-independent, constitutively active or dominant-negative phenotypes, is postulated to contribute to the endocrine resistance of tumors (Murphy, L. C. et al. (1997) Ann. Med. 29, 221-234; Leygue, E. et al. (1998) Cancer Res. 58, 3197-3201). Despite the fact that ERα and ERβ possess similar structural and biochemical properties, they display distinct activation properties for the expression of estrogen responsive genes. An alteration in the relative levels of ERα and ERβ when co-synthesized could, therefore, contribute to endocrine resistance by offsetting the balance between the regulatory potentials of ER-subtypes (Lazennec, G. et al. (2001) Endocrinology 142, 4120-4130; Speirs, V. et al. (1999) Cancer Res. 59, 525-528; Speirs, V. et al. (1999) Cancer Res. 59, 5421-5424). Aberrations in signaling pathways converging onto ER (post-translational processing) and/or ER-mediated events (promoter cross-talk) could also contribute to resistance by altering the sensitivity of ligand-ER mediated events or by circumventing the need for ligand-driven cell-growth (Kato, S. et al. (1998) Oncology 55 Suppl 1, 5-10; Nicholson, R. I. et al. (1999) Endocr Relat Cancer 6, 373-387).

Alterations in co-regulator expression or availability could also be one mechanism for the development of endocrine resistance. Tamoxifen resistance is characterized not only by the ineffectiveness of the compound to inhibit tumor growth but also by a gained ability to act as a partial agonist in breast cells. Co-regulatory proteins are present at rate-limiting levels in cells such that modification in the level of co-regulator expression or activity could lead to alterations in the ER signaling, consequently endocrine resistance (Shang, Y. et al. (2002) Science 295, 2465-2468). As discussed above, the transcriptional activity of the tamoxifen-ERα complex is modulated by the ratio between co-activator and co-repressor recruited to the complexes in cells within which tamoxifen acts as a partial agonist (Fujita, T. et al. (2003) J. Biol. Chem. 278, 26704-26714). A decrease in the level or activity of co-repressors (Lavinsky, R. M. et al. (1998) Proc. Natl. Acad. Sci. USA 95, 2920-2925; Graham, J. D. et al. (2000) J. Steroid Biochem. Mol. Biol. 74, 255-259; Graham, J. D. et al. (2000) Steroids 65, 579-584) with or without a concurrent increase in the level of co-activators (Hudelist, G. et al. (2003) Breast Cancer Res.

Treat. 78, 193-204; Font de Mora, J. et al. (2000) *Mol. Cell. Biol.* 20, 5041-5047) could therefore play a critical role in the development of tamoxifen resistance in ER positive breast cancers.

Studies showed that ERα positive breast cancer cells that are resistant to the growth-inhibitory effects of tamoxifen remain sensitive to growth inhibition by ICI 182,780 in experimental models in situ (Clarke, R. et al. (2001) *Pharmacol. Rev.* 53, 25-71; Brunner, N. et al. (1993) *Cancer Res.* 53, 3229-3232). It is likely that the ability of ICI 182,780 to promote monomerization of ER and subsequent degradation by preventing the nuclearicytopiasm shuttling of ER is the basis for its effectiveness as an antiestrogen. This interpretation is also consistent with second-line endocrine responses in patients who had relapsed on tamoxifen but responded to ICI 182,780 (Howell, A. et al. (1996) *Br. J. Cancer* 74, 300-308). It is unknown whether patients undergoing ICI 182,780 treatment develop resistance to the compound. However, the continuous long-term exposure of estrogen responsive breast cancer cells that are initially growth inhibited by ICI 182,780 develop resistance to the compound (Larsen, S. S. et al. (1997) *Int. J. Cancer* 72, 1129-1136; Brunner, N. et al. (1997) *Cancer Res.* 57, 3486-3493), as observed with experimental cell models (Simpson, E. R. et al. (2002) *Recent Prog. Horm. Res.* 57, 317-338). This appears, at least in part, to be due to the re-bounding synthesis of ERα with a concomitant increase in responsiveness to estrogens (Larsen, S. S. et al. (1997) *Int. J. Cancer* 72, 1129-1136). The regulation of ERα gene expression involves activity of several distinct promoters whose activities are mediated by AP-1, AP-2, and estrogen receptor factor 1 (ERF-1) binding sites that interact with a member of the AP-2 family proteins (Tang, Z. et al. (1997) *Mol. Cell. Biol.* 17, 1274-1280; deConinck, E. C. et al. (1995) Mol. Cell. Biol. 15, 2191-2196; Tanimoto, K. et al. (1999) *Nucleic Acids Res.* 27, 903-909). Similarly, Alu ERE, Oct-1, AP-1 and SP-1 sites regulate the expression of the ERβ gene (Li, L. C. et al. (2000) *Biochem. Biophys. Res. Commun.* 275, 682-689). There is evidence that both ERs also auto-regulate their own transcription (Castles, C. G. et al. (1997) *J. Steroid Biochem. Mol. Biol.* 62, 155-163; Vladusic, E. A. et al. (2000) *Oncol Rep* 7, 157-167). It is likely that modulation of the synthesis or activity of trans-acting factors responsible for the ER expression could be responsible for re-bounding/increase expression of ERs. This, together with findings that ICI 182,780 treatment can also lead to cross-resistance to tamoxifen (Brunner, N. et al. (1997) *Cancer Res.* 57, 3486-3493), indicates that the estrogen-mediated ER signaling participates in the development of acquired endocrine resistance. This reinforces expectations that inhibition of estrogen biosynthesis by aromatase inhibitors or by GnRH analogs together with antiestrogenic compounds could provide more effective treatment regimens for hormone responsive breast cancer.

As in endocrine de novo resistance, growth factor signaling pathways become up-regulated and/or activated in resistant breast cancer cells, which show an increased dependence on growth factor signaling pathways as an adaptive mechanism (Yarden, Y. (2001) *Oncology* 61 Suppl 2, 1-13). Therefore, blockage or inhibition of growth factor signaling pathways in acquired endocrine resistance could also provide a basis for treatment. Indeed, in situ, in vivo, and clinical studies clearly indicate that inhibition of a variety of growth factor-mediated signaling processes is effective in the prevention of endocrine-resistant phenotypes Nicholson, R. I. et al. (2001) *Endocr Relat Cancer* 8, 175-182; Jeng, M. H. et al. (2000) *Breast Cancer Res. Treat.* 62, 167-175). The efficacy of anti-growth factor modalities can be further enhanced by combined treatments involving estrogen synthesis inhibitors and/or antiestrogens (Wakeling, A. E. et al. (2001) *Clin Cancer Res* 7, 4350s-4355s).

The term "expression signature" or "signature" refers to a group of two or more coordinately expressed biomarkers. For example, the genes, proteins, metabolites, and the like making up this signature may be expressed in a specific cell lineage, stage of differentiation, or during a particular biological response. The biomarkers can reflect biological aspects of the tumors in which they are expressed, such as the cell of origin of the cancer, the nature of the non-malignant cells in the biopsy, and the oncogenic mechanisms responsible for the cancer. Expression data and gene expression levels can be stored on computer readable media, e.g., the computer readable medium used in conjunction with a microarray or chip reading device. Such expression data can be manipulated to generate expression signatures.

A molecule is "fixed" or "affixed" to a substrate if it is covalently or non-covalently associated with the substrate such that the substrate can be rinsed with a fluid (e.g. standard saline citrate, pH 7.4) without a substantial fraction of the molecule dissociating from the substrate.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-ATTGCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

The term "inhibit" includes the decrease, limitation, or blockage, of, for example a particular action, function, or interaction. In some embodiments, cancer is "inhibited" if at least one symptom of the cancer is alleviated, terminated, slowed, or prevented. As used herein, cancer is also "inhibited" if recurrence or metastasis of the cancer is reduced, slowed, delayed, or prevented. Similarly, a biological function, such as the function of a protein, is inhibited if it is decreased as compared to a reference state, such as a control like a wild-type state. For example, kinase activity of a mutant PAK2 or a PAK2 that is contacted with a PAK2 inhibitor is inhibited or deficient if the kinase activity is decreased due to the mutation and/or contact with the inhibitor, in comparison to the wild-type PAK2 and/or the PAK2 not contacted with the inhibitor. Such inhibition or deficiency can be induced, such as by application of agent at a particular time and/or place, or can be constitutive, such as by a heritable mutation. Such inhibition or deficiency can also be partial or complete (e.g., essentially no measurable activity in comparison to a reference state, such as a control like a wild-type state). Essentially complete inhibition or deficiency is referred to as blocked.

The term "interaction", when referring to an interaction between two molecules, refers to the physical contact (e.g., binding) of the molecules with one another. Generally, such an interaction results in an activity (which produces a biological effect) of one or both of said molecules.

An "isolated protein" refers to a protein that is substantially free of other proteins, cellular material, separation medium, and culture medium when isolated from cells or produced by recombinant DNA techniques, or chemical precursors or other chemicals when chemically synthesized. An "isolated" or "purified" protein or biologically active portion thereof is substantially free of cellular material or other contaminating proteins from the cell or tissue source from which the antibody, polypeptide, peptide or fusion protein is derived, or substantially free from chemical precursors or other chemicals when chemically synthesized. The language "substantially free of cellular material" includes preparations of a biomarker polypeptide or fragment thereof, in which the protein is separated from cellular components of the cells from which it is isolated or recombinantly produced. In one embodiment, the language "substantially free of cellular material" includes preparations of a biomarker protein or fragment thereof, having less than about 30% (by dry weight) of non-biomarker protein (also referred to herein as a "contaminating protein"), more preferably less than about 20% of non-biomarker protein, still more preferably less than about 10% of non-biomarker protein, and most preferably less than about 5% non-biomarker protein. When antibody, polypeptide, peptide or fusion protein or fragment thereof, e.g., a biologically active fragment thereof, is recombinantly produced, it is also preferably substantially free of culture medium, i.e., culture medium represents less than about 20%, more preferably less than about 10%, and most preferably less than about 5% of the volume of the protein preparation.

A "kit" is any manufacture (e.g. a package or container) comprising at least one reagent, e.g. a probe or small molecule, for specifically detecting and/or affecting the expression of a marker of the present invention. The kit may be promoted, distributed, or sold as a unit for performing the methods of the present invention. The kit may comprise one or more reagents necessary to express a composition useful in the methods of the present invention. In certain embodiments, the kit may further comprise a reference standard, e.g., a nucleic acid encoding a protein that does not affect or regulate signaling pathways controlling cell growth, division, migration, survival or apoptosis. One skilled in the art can envision many such control proteins, including, but not limited to, common molecular tags (e.g., green fluorescent protein and beta-galactosidase), proteins not classified in any of pathway encompassing cell growth, division, migration, survival or apoptosis by GeneOntology reference, or ubiquitous housekeeping proteins. Reagents in the kit may be provided in individual containers or as mixtures of two or more reagents in a single container. In addition, instructional materials which describe the use of the compositions within the kit can be included.

The term "long-term estradiol-deprived" or LTED refers to cells that have been culture under prolonged estrogen-deprived conditions. LTED cells are refractory to tamoxifen but sensitive to fulvestrant.

The term "micrometastasis" as used herein is preferably defined as a group of confluent cancer cells measuring from greater than 0.2 mm and/or having greater than 200 cells to 2 mm in maximum width. More preferably "micrometastasis" is defined as a group of confluent cancer cells from 0.2 mm to 2 mm in maximum width (see Edge et al. (2010) *AJCC Cancer Staging Manual and Handbook* (7th ed.)). An alternative preferred definition of "micrometastasis" is a confluent group of at least 1000 cancer cells and at least 0.1 mm in widest dimension up to 1 mm in widest dimension. Micrometastasis is generally not visible in standard contrast MRI imaging or other clinical imaging techniques. However, in certain cancers, radioactive antibodies directed to tumor selective antigens (e.g., Her2 for breast cancer metastasis) allows for visualization of micrometastasis. Other indirect detection methods include contrast media leakage at brain micrometastasis sites due to VEGF induced vascular leakage (Yano et al. (2000) *Cancer Res.* 60:4959-49067; U.S. Pat. Publ. 2015/0352113). More sensitive imaging techniques may also be applied to detect micrometastases. For example, blood volume may be imaged by MRI using the alternative contrast agent, USPIO (Molday Iron, Biopal, Worcester, Mass.) to detect micrometastasis (Yin et al. (2009) *Clin. Exp. Metastasis.* 26:403-414).

The term "neoadjuvant therapy" refers to a treatment given before the primary treatment. Examples of neoadjuvant therapy can include chemotherapy, radiation therapy, and hormone therapy. For example, in treating breast cancer, neoadjuvant therapy can allows patients with large breast cancer to undergo breast-conserving surgery.

The "normal" level of expression of a biomarker is the level of expression of the biomarker in cells of a subject, e.g., a human patient, not afflicted with a cancer. An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

The term "pre-determined" biomarker amount and/or activity measurement(s) may be a biomarker amount and/or activity measurement(s) used to, by way of example only, evaluate a subject that may be selected for a particular treatment, evaluate a response to a treatment such as a PD-1 pathway inhibitor therapy, and/or evaluate the disease state. A pre-determined biomarker amount and/or activity measurement(s) may be determined in populations of patients with or without cancer. The pre-determined biomarker amount and/or activity measurement(s) can be a single number, equally applicable to every patient, or the pre-determined biomarker amount and/or activity measurement(s) can vary according to specific subpopulations of patients. Age, weight, height, and other factors of a subject may affect the pre-determined biomarker amount and/or activity measurement(s) of the individual. Furthermore, the pre-determined biomarker amount and/or activity can be determined for each subject individually. In one embodiment, the amounts determined and/or compared in a method described herein are based on absolute measurements. In another embodiment, the amounts determined and/or compared in a method described herein are based on relative measurements, such as ratios (e.g., serum biomarker normalized to the expression of a housekeeping or otherwise generally constant biomarker). The pre-determined biomarker amount and/or activity measurement(s) can be any suitable standard. For example, the pre-determined biomarker amount and/or activity measurement(s) can be obtained from the same or a different human for whom a patient selection is being assessed. In one embodiment, the pre-determined biomarker amount and/or activity measurement(s) can be obtained from a previous assessment of the same patient. In such a manner, the progress of the selection of the patient can be monitored over time. In addition, the control can be obtained from an assessment of another human or multiple humans, e.g., selected groups of humans, if the subject is a human. In such a manner, the extent of the selection of the human for whom selection is being assessed can be compared to suitable other humans, e.g., other humans who are in a similar situation to the human of interest, such as those suffering from similar or the same condition(s) and/or of the same ethnic group.

The term "predictive" includes the use of a biomarker nucleic acid and/or protein status, e.g., over- or under-activity, emergence, expression, growth, remission, recurrence or resistance of tumors before, during or after therapy, for determining the likelihood of response of a cancer to endocrine therapy. Such predictive use of the biomarker may be confirmed by, e.g., (1) increased or decreased copy number (e.g., by FISH, FISH plus SKY, single-molecule sequencing, e.g., as described in the art at least at Augustin et al. (2001) *J. Biotechnol.*, 86:289-301, or qPCR), overexpression or underexpression of a biomarker nucleic acid (e.g., by ISH, Northern Blot, or qPCR), increased or decreased biomarker protein (e.g., by IHC), or increased or decreased activity, e.g., in more than about 5%, 6%, 7%, 8%, 9%, 10%, 11%, 12%, 13%, 14%, 15%, 20%, 25%, 30%, 40%, 50%, 60%, 70%, 80%, 90%, 95%, 100%, or more of assayed human cancers types or cancer samples; (2) its absolute or relatively modulated presence or absence in a biological sample, e.g., a sample containing tissue, whole blood, serum, plasma, buccal scrape, saliva, cerebrospinal fluid, urine, stool, or bone marrow, from a subject, e.g. a human, afflicted with cancer; (3) its absolute or relatively modulated presence or absence in clinical subset of patients with cancer (e.g., those responding to a particular endocrine or non-endocrine therapy or those developing resistance thereto).

The term "pre-malignant lesions" as described herein refers to a lesion that, while not cancerous, has potential for becoming cancerous. It also includes the term "pre-malignant disorders" or "potentially malignant disorders." In particular this refers to a benign, morphologically and/or histologically altered tissue that has a greater than normal risk of malignant transformation, and a disease or a patient's habit that does not necessarily alter the clinical appearance of local tissue but is associated with a greater than normal risk of precancerous lesion or cancer development in that tissue (leukoplakia, erythroplakia, erytroleukoplakia lichen planus (lichenoid reaction) and any lesion or an area which histological examination showed atypia of cells or dysplasia. In one embodiment, a metaplasia is a pre-malignant lesion.

The terms "prevent," "preventing," "prevention," "prophylactic treatment," and the like refer to reducing the probability of developing a disease, disorder, or condition in a subject, who does not have, but is at risk of or susceptible to developing a disease, disorder, or condition.

The term "probe" refers to any molecule which is capable of selectively binding to a specifically intended target molecule, for example, a nucleotide transcript or protein encoded by or corresponding to a biomarker nucleic acid. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic molecules.

The term "prognosis" includes a prediction of the probable course and outcome of cancer or the likelihood of recovery from the disease. In some embodiments, the use of statistical algorithms provides a prognosis of cancer in an individual. For example, the prognosis can be surgery, development of a clinical subtype of cancer (e.g., solid tumors, such as ER+ breast cancer), development of one or more clinical factors, or recovery from the disease.

The term "response to anti-cancer therapy" relates to any response of the hyperproliferative disorder (e.g., cancer) to an anti-cancer agent, preferably to a change in tumor mass and/or volume after initiation of neoadjuvant or adjuvant chemotherapy. Hyperproliferative disorder response may be assessed, for example for efficacy or in a neoadjuvant or adjuvant situation, where the size of a tumor after systemic intervention can be compared to the initial size and dimensions as measured by CT, PET, mammogram, ultrasound or palpation. Responses may also be assessed by caliper measurement or pathological examination of the tumor after biopsy or surgical resection. Response may be recorded in a quantitative fashion like percentage change in tumor volume or in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of hyperproliferative disorder response may be done early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed. This is typically three months after initiation of neoadjuvant therapy. In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular cancer therapeutic regimen is at least 25%, 30%, 35%, 40%, 45%, 50%, 55%, 60%, 65%, 70%, 75%, 80%, 85%, or more. Additional criteria for evaluating the response to cancer therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence. For example, in order to determine appropriate threshold values, a particular cancer therapeutic regimen can be administered to a population of subjects and the outcome can be correlated to biomarker measurements that were determined prior to administration of any cancer therapy. The outcome measurement may be pathologic response to therapy given in the neoadjuvant setting. Alternatively, outcome measures, such as overall survival and disease-free survival can be monitored over a period of time for subjects following cancer therapy for whom biomarker measurement values are known. In certain embodiments, the doses administered are standard doses known in the art for cancer therapeutic agents. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of a cancer therapy can be determined using well-known methods in the art, such as those described in the Examples section.

The term "resistance" refers to an acquired or natural resistance of a cancer sample or a mammal to a cancer therapy (i.e., being nonresponsive to or having reduced or limited response to the therapeutic treatment), such as having a reduced response to a therapeutic treatment by 25% or more, for example, 30%, 40%, 50%, 60%, 70%, 80%, or more, to 2-fold, 3-fold, 4-fold, 5-fold, 10-fold, 15-fold, 20-fold or more. The reduction in response can be measured by comparing with the same cancer sample or mammal before the resistance is acquired, or by comparing with a different cancer sample or a mammal who is known to have no resistance to the therapeutic treatment. A typical acquired resistance to chemotherapy is called "multidrug resistance." The multidrug resistance can be mediated by P-glycoprotein or can be mediated by other mechanisms, or it can occur when a mammal is infected with a multi-drug-resistant microorganism or a combination of microorganisms. The determination of resistance to a therapeutic treatment is routine in the art and within the skill of an ordinarily skilled clinician, for example, can be measured by cell proliferative assays and cell death assays as described herein as "sensitizing." In some embodiments, the term "reverses resistance" means that the use of a second agent in combination with a primary cancer therapy (e.g., chemotherapeutic or radiation therapy) is able to produce a significant decrease in tumor volume at a level of statistical significance (e.g., $p<0.05$) when compared to tumor volume of untreated tumor in the circumstance where the primary cancer therapy (e.g., chemotherapeutic or radiation therapy) alone is unable to produce a statistically significant decrease in tumor volume compared to tumor volume of untreated tumor. This generally applies to tumor volume measurements made at a time when the untreated tumor is growing log rhythmically.

The terms "response" or "responsiveness" refers to an anti-cancer response, e.g. in the sense of reduction of tumor size or inhibiting tumor growth. The terms can also refer to an improved prognosis, for example, as reflected by an increased time to recurrence, which is the period to first recurrence censoring for second primary cancer as a first event or death without evidence of recurrence, or an increased overall survival, which is the period from treatment to death from any cause. To respond or to have a response means there is a beneficial endpoint attained when exposed to a stimulus. Alternatively, a negative or detrimental symptom is minimized, mitigated or attenuated on exposure to a stimulus. It will be appreciated that evaluating the likelihood that a tumor or subject will exhibit a favorable response is equivalent to evaluating the likelihood that the tumor or subject will not exhibit favorable response (i.e., will exhibit a lack of response or be non-responsive).

An "RNA interfering agent" as used herein, is defined as any agent which interferes with or inhibits expression of a target biomarker gene by RNA interference (RNAi). Such RNA interfering agents include, but are not limited to, nucleic acid molecules including RNA molecules which are homologous to the target biomarker gene of the present invention, or a fragment thereof, short interfering RNA (siRNA), and small molecules which interfere with or inhibit expression of a target biomarker nucleic acid by RNA interference (RNAi).

"RNA interference (RNAi)" is an evolutionally conserved process whereby the expression or introduction of RNA of a sequence that is identical or highly similar to a target biomarker nucleic acid results in the sequence specific degradation or specific post-transcriptional gene silencing (PTGS) of messenger RNA (mRNA) transcribed from that targeted gene (see Coburn, G et al. (2002) *J. of Virology* 76(18):9225), thereby inhibiting expression of the target biomarker nucleic acid. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs or RNA interfering agents, to inhibit or silence the expression of target biomarker nucleic acids. As used herein, "inhibition of target biomarker nucleic acid expression" or "inhibition of marker gene expression" includes any decrease in expression or protein activity or level of the target biomarker nucleic acid or protein encoded by the target biomarker nucleic acid. The decrease may be of at least 30%, 40%, 50%, 60%, 70%, 80%, 90%, 95% or 99% or more as compared to the expression of a target biomarker nucleic acid or the activity or level of the protein encoded by a target biomarker nucleic acid which has not been targeted by an RNA interfering agent.

The term "sample" used for detecting or determining the presence or level of at least one biomarker is typically whole blood, plasma, serum, saliva, urine, stool (e.g., feces), tears, and any other bodily fluid (e.g., as described above under the definition of "body fluids"), or a tissue sample (e.g., biopsy) such as a small intestine, colon sample, or surgical resection tissue. In certain instances, the method of the present invention further comprises obtaining the sample from the individual prior to detecting or determining the presence or level of at least one marker in the sample.

The term "sensitize" means to alter cancer cells or tumor cells in a way that allows for more effective treatment of the associated cancer with a cancer therapy (e.g., chemotherapeutic, and/or radiation therapy). In some embodiments, normal cells are not affected to an extent that causes the normal cells to be unduly injured by the endocrine or non-endocrine therapy. An increased sensitivity or a reduced sensitivity to a therapeutic treatment is measured according to a known method in the art for the particular treatment and methods described herein below, including, but not limited to, cell proliferative assays (Tanigawa, N et al. (9821) *Cancer Res* 42: 2159-2164), cell death assays (Weisenthal, L et al. (1984) *Cancer Res* 94: 161-173; Weisenthal, L et al. (1985) *Cancer Treat Rep* 69: 615-632; Weisenthal, L et al. Harwood Academic Publishers, 1993: 415-432; Weisenthal, L (1994) *Contrib Gynecol Obstet* 19: 82-90). The sensitivity or resistance may also be measured in animal by measuring the tumor size reduction over a period of time, for example, 6 month for human and 4-6 weeks for mouse. A composition or a method sensitizes response to a therapeutic treatment if the increase in treatment sensitivity or the reduction in resistance is 25% or more, for example, 30%, 40%, 50%, 60%, 70%, 80%, or more, to 2-fold, 3-fold, 4-fold, 5-fold, 10-fold, 15-fold, 20-fold or more, compared to treatment sensitivity or resistance in the absence of such composition or method. The determination of sensitivity or resistance to a therapeutic treatment is routine in the art and within the skill of an ordinarily skilled clinician. It is to be understood that any method described herein for enhancing the efficacy of a cancer therapy can be equally applied to methods for sensitizing hyperproliferative or otherwise cancerous cells (e.g., resistant cells) to the cancer therapy.

The term "Src family kinase signaling pathway" or "SFKSP" refers to members (e.g., upstream, downstream, adaptors, and the like) of the Src Family Kinases (SFKs), such as the nine members of the human SFK family, as well as modulators of SFKs including, but not limited to, CSK, PAK2 and CRK. Additional SFKSP members may include, but not limited to, Killer Cell Lectin Like Receptor F1 (KLRF1), Serine/Threonine Kinase 33 (STK33), EPH Receptor B2 (EPHB2), Gamma-Aminobutyric Acid Type A Receptor Alpha4 Subunit (GABRA4), Phosphatidylinositol 4-Kinase Type 2 Alpha (PI4K2A), Phosphoinositide-3-Kinase Regulatory Subunit 2 (PIK3R2), Cholinergic Receptor Nicotinic Alpha 1 Subunit (CHRNA1), N-Acetylglucosamine-1-Phosphodiester Alpha-N-Acetylglucosaminidase (NAGPA), Protocadherin Beta 15 (PCDHB15), Uracil Phosphoribosyltransferase Homolog (UPRT), Glutamate Ionotropic Receptor NMDA Type Subunit 1 (GRIN1), Protein Tyrosine Phosphatase Non-Receptor Type 2 (PTPN2), Signal Transducer And Activator Of Transcription 3 (STAT3), HCK Proto-Oncogene Src Family Tyrosine Kinase (HCK), NCK Adaptor Protein 1 (NCK1), Janus Kinase 1 (JAK1), SRC Proto-Oncogene Non-Receptor Tyrosine Kinase (SRC), Zinc Finger Protein 658B (Pseudogene) (ZNF658B), Epidermal Growth Factor Receptor (EGFR), Artemin (ARTN), Solute Carrier Family 4 Member 4 (SLC4A4), Mechanistic Target Of Rapamycin (MTOR), Actin, Beta (ACTB), RUN And FYVE Domain Containing 1 (RUFY1), Protein Kinase C Alpha (PRKCA), Mitogen-Activated Protein Kinase 3 (MAPK3), and V-Akt Murine Thymoma Viral Oncogene Homolog 1 (AKT1). Human and orthologous nucleic acid and amino acid sequences of SFKSP members are publicly available on the GenBank database maintained by the U.S. National Center for Biotechnology Information. Representative nucleic acid and polypeptide sequences are indicated below.

In particular, SFKs are a family of redundant kinases that interact with many cellular cytosolic, nuclear and membrane proteins, modifying these proteins by phosphorylation of tyrosine residues. The term "pan-SFK" refers to the entire set or a plurality of members of the SFK family. For example, a "pan-SFK inhibitor" inhibits at least 2, 3, 4, 5, 6, 7, 8, or 9 SFK family members. Examples of pan-SFK inhibitors include, but not limited to, Dasatinib and Saracatinib. By contrast, an "SFK selective inhibitor" preferentially inhibits a single SFK family member. Anti-SFK agents, may include intrabodies, nucleic acids, and the like are well-known in the art. SFK members include Leukocyte C-Terminal Proto-Oncogene Tyrosine Kinase (LCK), SRC Rous sarcoma Proto-Oncogene, Non-Receptor Tyrosine Kinase (SRC), Hemopoietic Cell Kinase Proto-Oncogene Tyrosine Kinase (HCK), FYN Proto-Oncogene Tyrosine Kinase (FYN), LYN Proto-Oncogene Tyrosine Kinase (LYN), Feline Gardner-Rasheed Proto-Oncogene Tyrosine Kinase (FGR), B Lymphoid Proto-Oncogene, Src Family Tyrosine Kinase (BLK), Fyn Related Src Family Tyrosine Kinase (FRK), and Yes-1 Yamaguchi Proto-Oncogene 1Tyrosine Kinase (YES1).

As used herein, the term "CSK" refers to the c-src tyrosine kinase, which is a non-receptor tyrosine-protein kinase that plays an important role in the regulation of cell growth, differentiation, migration and immune response. CSK phosphorylates tyrosine residues located in the C-terminal tails of Src-family kinases (SFKs) including LCK, SRC, HCK, FYN, LYN or YES1. Upon tail phosphorylation, Src-family members engage in intramolecular interactions between the phosphotyrosine tail and the SH2 domain that result in an inactive conformation. To inhibit SFKs, CSK is recruited to the plasma membrane via binding to transmembrane proteins or adapter proteins located near the plasma membrane. CSK suppresses signaling by various surface receptors, including T-cell receptor (TCR) and B-cell receptor (BCR) by phosphorylating and maintaining inactive several positive effectors such as FYN or LCK. CSK is herein shown to be an estrogen-stimulated tumor suppressor. Since cell transformation by SRC oncoproteins is caused by various mechanisms that interfere with this phosphorylation, the CSK gene might function as an antioncogene (Armstrong et al. (1992) *Cytogenet. Cell Genet.* 60:119-120). The Src homology-3 (SH3) domain of CSK associates with a proline-rich region of PEP, a protein-tyrosine phosphatase expressed in hemopoietic cells (Cloutier et al. (1996 *EMBO J.* 15: 4909-4918). This association is highly specific and it has been speculated that PEP may be an effector and/or regulator of CSK in T cells and other hemopoietic cells. CSK physically interacts with the intracellular phosphatase LYP (PTPN22) and can modify the activation state of downstream Src kinases, such as LYN, in lymphocytes. CSK also plays a critical role in mediating G protein signals in the reorganization of the actin cytoskeleton (Lowry et al. (2002)

Dev. Cell 2: 733-744). Inhibitors of CSK include, but not limited to, Staurosporine, TG100801, and apatinib. Activators of CSK may include, but not limited to, human CSK nucleic acid molecules and polypeptides molecules and orthologs thereof. Representative nucleic acid and polypeptide sequences are provided in Table 1.

As used herein, the term "PAK2" refers to the p21-activated kinase 2. Ras (HRAS)-related GTPases, or p21 proteins, of the Rho (RHOA) subfamily are critical regulators of signal transduction pathways. The p21-activated kinases (PAKs) are a family of serine/threonine kinases that are central to signal transduction and cellular regulation. PAKs are involved in a variety of cellular processes, including cytoskeletal dynamics, cell motility, gene transcription, death and survival signaling, and cell cycle progression. Consequently, PAKs are implicated in numerous pathologic conditions and in cell transformation. The PAK family is divided into 2 subfamilies, group I and group II, based on domain architecture and regulation. Group I, the conventional PAKs, includes PAK1, PAK2, and PAK3, which are activated upon binding the GTP-bound forms of the Rho GTPases CDC42 and RAC1. Group II, the nonconventional PAKs, includes PAK4, PAK5 (PAK7 and PAK6, which are active independent of Rho GTPases (reviews by Zhao et al. (2005) Biochem. J. 386: 201-214 and Eswaran et al. (2008) Trends Biochem. Sci. 33: 394-403).

PAK2 (p21 protein-activated kinase 2) is a serine/threonine kinase whose activity can be stimulated by small GTPases CDC42 and RAC130 and regulated by the Src Family Kinases (SFKs) (Renkema et al. (2002) Mol. Cell. Biol. 22:6719-6725; Koh et al. (2009) J. Cell. Sci. 122:1812-1822). PAK2 plays a role in a variety of different signaling pathways including cytoskeleton regulation, cell motility, cell cycle progression, apoptosis or proliferation. Acts as downstream effector of the small GTPases CDC42 and RAC1. Activation by the binding of active CDC42 and RAC1 results in a conformational change and a subsequent autophosphorylation on several serine and/or threonine residues. Full-length PAK2 stimulates cell survival and cell growth. PAK2 phosphorylates MAPK4 and MAPK6 and activates the downstream target MAPKAPKS, a regulator of F-actin polymerization and cell migration. PAK2 phosphorylates JUN and plays an important role in EGF-induced cell proliferation. PAK2 phosphorylates many other substrates including histone H4 to promote assembly of H3.3 and H4 into nucleosomes, BAD, ribosomal protein S6, or MBP. Additionally, associates with ARHGEF7 and GIT1 to perform kinase-independent functions such as spindle orientation control during mitosis. On the other hand, apoptotic stimuli such as DNA damage lead to caspase-mediated cleavage of PAK2, generating PAK-2p34, an active p34 fragment that translocates to the nucleus and promotes cellular apoptosis involving the JNK signaling pathway. Caspase-activated PAK2 phosphorylates MKNK1 and reduces cellular translation. Inhibitors of PAK2 include, but not limited to FRAX597. Additional inhibitors of PAK2 block phosphorylation of PAK2 at the following Tyrosine residues: Y130, Y139, Y194. Inhibitors of PAK2 may comprise phosphorylation defective PAK2, such as PAK2 Y130F, PAK2 Y139F, and PAK2 (Y194F). Representative nucleic acid and polypeptide sequences are provided in Table 2.

Binding analysis confirmed that PAK2 associates with the p21 proteins CDC42 and RAC1, but not with RHOA (ARHA) (Martin et al. (1995) EMBO J. 14: 1970-1978). Functional analysis determined that CDC42 and RAC1 induce autophosphorylation of PAK2, which stimulates sustained phosphorylation of other substrates.

PAK2 is unique among PAK family members in that it can be activated by proteolytic cleavage to generate a constitutively active fragment, PAK2p34. Activation of PAK2 by RAC or CDC42 stimulates cell survival, whereas caspase-activated PAK2p34 induces a cell death response. Using yeast 2-hybrid analysis, it was determined that PSGAP (ARHGAP10) interacted specifically with PAK2p34, but not with active or inactive full-length PAK2, in vitro and in vivo via a region between the GAP and SH3 domains of PSGAP (Koeppel et al. (2004) J. Biol. Chem. 279: 53653-53664). The interaction with PSGAP inhibited the protein kinase activity of PAK2p34 in vitro and changed the localization of PAK2p24 from the nucleus to the perinuclear region. Furthermore, PSGAP appeared to regulate the ability of PAK2p34 to induce programmed cell death.

As used herein, the term "CRK" refers to the proto-oncogene c-crk or avian sarcoma virus CT10 (v-crk) homolog, which is a member of an adapter protein family that binds to several tyrosine-phosphorylated proteins and involved in activating SFKs (Sabe et al. (1992) Mol. Cell. Biol. 12:4706-4713). The CRK oncogene was originally identified as a transforming component of the avian sarcoma virus CT10. A cDNA encoding the chicken cellular homolog of v-crk was isolated by Reichman et al. (1992) Cell Growth Differ. 3: 451-460 and shown to consist primarily of the SRC (190090) homology domains SH2 and SH3. Matsuda et al. (1992) Molec. Cell. Biol. 12: 3482-3489 isolated 2 distinct human CRK cDNA species and showed that the deduced amino acid sequences of the corresponding polypeptides differed in their C termini. The 2 cDNA species were considered to derive from the same genomic locus by alternative splicing.

Feller et al. (1994) Trends Biochem. Sci. 19: 453-458 described the SRC homology domains SH2 and SH3 as molecular adhesives on many proteins involved in signal transduction. They reviewed the interactions of ABL and CRK as a model of SH2 and SH3 interaction. Hallock et al. (2010) Genes Dev. 24: 2451-2461 found that Crk and Crkl were recruited to mouse skeletal muscle synapses and played redundant roles in synaptic differentiation. Crk and Crkl bound the same tyrosine-phosphorylated sequences in Dok7, a protein that functions downstream of agrin (AGRN) and muscle-specific receptor kinase (MUSK) in synapse formation. CRK has several SH2 and SH3 domains (src-homology domains) and is involved in several signaling pathways, recruiting cytoplasmic proteins in the vicinity of tyrosine kinase through SH2-phosphotyrosine interaction. The N-terminal SH2 domain of this protein functions as a positive regulator of transformation whereas the C-terminal SH3 domain functions as a negative regulator of transformation. Two alternative transcripts encoding different isoforms with distinct biological activity have been described. The Crk-I and Crk-II forms differ in their biological activities. Crk-II has less transforming activity than Crk-I. Crk-II mediates attachment-induced MAPK8 activation, membrane ruffling and cell motility in a Rac-dependent manner CRK is involved in phagocytosis of apoptotic cells and cell motility via its interaction with DOCK1 and DOCK4. CRK may regulate the EFNA5-EPHA3 signaling. CRK interacts with ABL1, C3G, DOCK3, MAP4K1, MAPK8 and SOS via its first SH3 domain. CRK interacts (via SH2 domain) with BCAR1, CBL, CBLB, PXN, IRS4 and GAB1 upon stimulus-induced tyrosine phosphorylation. CRK interacts (via SH2 domain) with several tyrosine-phosphorylated growth factor receptors such as EGFR and INSR. CRK interacts with FLT1 (tyrosine-phosphorylated). CRK interacts with DOCK1 and DOCK4, SHB, PEAK1, and FASLG. Isoform Crk-II interacts with KIT. CRK interacts with EPHA3; upon activation of EPHA3 by the ligand EFNA5 and EPHA3 tyrosine kinase activity-dependent. CRK interacts with EPHA3 (phosphorylated); mediates EFNA5-EPHA3 signaling through RHOA GTPase activation. CRK interacts with FLT4 (tyrosine-phosphorylated). Isoform Crk-II (via SH2 domain) interacts with PDGFRA (tyrosine phosphorylated) and PDGFRB (tyrosine phosphorylated). CRK is part of a collagen stimulated complex involved in cell migration composed of CDC42, CRK, TNK2 and p130cas/BCAR1. CRK interacts (via SH2 domain) with the Tyr-9 phosphorylated form of PDPK1. CRK interacts with CBLC. CRK is found in a complex with ABL1, ABL2, CRK and UNC119; leading to the inhibition of CRK phosphorylation by ABL kinases. Representative nucleic acid and polypeptide sequences are provided in Table 2.

BLK encodes a nonreceptor tyrosine-kinase of the src family of proto-oncogenes that are typically involved in cell proliferation and differentiation. The protein has a role in B-cell receptor signaling and B-cell development. The protein also stimulates insulin synthesis and secretion in response to glucose and enhances the expression of several pancreatic beta-cell transcription factors. BLK is involved in B-lymphocyte development, differentiation and signaling. B-cell receptor (BCR) signaling requires a tight regulation of several protein tyrosine kinases and phosphatases, and associated coreceptors. Binding of antigen to the B-cell antigen receptor (BCR) triggers signaling that ultimately leads to B-cell activation. Signaling through BLK plays an important role in transmitting signals through surface immunoglobulins and supports the pro-B to pre-B transition, as well as the signaling for growth arrest and apoptosis downstream of B-cell receptor. BLK specifically binds and phosphorylates CD79A at Tyr-188 and Tyr-199, as well as CD79B at Tyr-196 and Tyr-207. BLK phosphorylates also the immunoglobulin G receptors FCGR2A, FCGR2B and FCGR2C. With FYN and LYN, BLK plays an essential role in pre-B-cell receptor (pre-BCR)-mediated NF-kappa-B activation. BLK contributes also to BTK activation by indirectly stimulating BTK intramolecular autophosphorylation. In pancreatic islets, BLK acts as a modulator of beta-cells function through the up-regulation of PDX1 and NKX6-1 and consequent stimulation of insulin secretion in response to glucose. Inhibitors of BLK include, but not limited to, ENMD-2076.

Nucleic acid and polypeptide sequences of BLK are well-known and include, but not limited to, human BLK (NM_001715.2, NP_001706.2), chimp BLK (XM_016959095.1, XP_016814584.1), dog BLK (XM_543206.4, XP_543206.2), and cow BLK (NM_001075968.2, NP_001069436.1), mouse BLK (NM_007549.2, NP_031575.2), rat BLK (NM_001025751.1, NP_001020922.1), and chicken BLK (XM_004935895.2, XP_004935952.1).

FGR is a member of the Src family of protein tyrosine kinases (PTKs). The encoded protein contains N-terminal sites for myristylation and palmitylation, a PTK domain, and SH2 and SH3 domains which are involved in mediating protein-protein interactions with phosphotyrosine-containing and proline-rich motifs, respectively. The protein localizes to plasma membrane ruffles, and functions as a negative regulator of cell migration and adhesion triggered by the beta-2 integrin signal transduction pathway. Infection with Epstein-Barr virus results in the overexpression of this gene. Multiple alternatively spliced variants, encoding the same protein, have been identified. FGR transmits signals from cell surface receptors devoid of kinase activity and contributes to the regulation of immune responses, including neutrophil, monocyte, macrophage and mast cell functions, cytoskeleton remodeling in response to extracellular stimuli, phagocytosis, cell adhesion and migration. FGR promotes mast cell degranulation, release of inflammatory cytokines and IgE-mediated anaphylaxis. FGR acts downstream of receptors that bind the Fc region of immunoglobulins, such as MS4A2/FCER1B, FCGR2A and/or FCGR2B. FGR acts downstream of ITGB1 and ITGB2, and regulates actin cytoskeleton reorganization, cell spreading and adhesion. Depending on the context, FGR activates or inhibits cellular responses. FGR functions as negative regulator of ITGB2 signaling, phagocytosis and SYK activity in monocytes. FGR is required for normal ITGB1 and ITGB2 signaling, normal cell spreading and adhesion in neutrophils and macrophages. FGR functions as positive regulator of cell migration and regulates cytoskeleton reorganization via RAC1 activation. FGR phosphorylates SYK (in vitro) and promotes SYK-dependent activation of AKT1 and MAP kinase signaling. FGR phosphorylates PLD2 in antigen-stimulated mast cells, leading to PLD2 activation and the production of the signaling molecules lysophosphatidic acid and diacylglycerol. FGR promotes activation of PIK3R1. FGR phosphorylates FASLG, and thereby regulates its ubiquitination and subsequent internalization. FGR phosphorylates ABL1. FGR promotes phosphorylation of CBL, CTTN, PIK3R1, PTK2/FAK1, PTK2B/PYK2 and VAV2. FGR phosphorylates HCLS1 that has already been phosphorylated by SYK, but not unphosphorylated HCLS1. Inhibitors of FGR include, but not limited to, Phosphodiesterase 5 Inhibitors, Phosphodiesterase Inhibitors, Sildenafil Citrate, and Vasodilator Agents.

Nucleic acid and polypeptide sequences of FGR are well-known and include, but not limited to, human FGR (NM_005248.2, NP_005239.1), chimp FGR (XM_016957241.1, XP_003307960.1), monkey FGR (NM_001258057.1, NP_001244986.1), dog FGR (XM_544467.5, XP_544467.2), and cow FGR (NM_001098991.1, NP_001092461.1), mouse FGR (NM_010208.4, NP_034338.3), rat FGR (NM_024145.2, NP_077059.2), and chicken FGR (NM_001109787.1, NP_001103257.1).

FRK is a nuclear protein and may function during G1 and S phase of the cell cycle and suppress growth. FRK negatively regulates cell proliferation. FRK positively regulates PTEN protein stability through phosphorylation of PTEN on Tyr-336, which in turn prevents its ubiquitination and degradation, possibly by reducing its binding to NEDD4. FRK may function as a tumor suppressor. Inhibitors of FRK include, but not limited to, regorafenib and Stivarga.

Nucleic acid and polypeptide sequences of FRK are well-known and include, but not limited to, human FRK (NM_002031.2, NP_002022.1), chimp FRK (XM_518702.5, XP_518702.3), monkey FRK (XM_015137546.1, XP_001112190.1), dog FRK (XM_539091.4, XP_539091.2), and cow FRK (XM_002690084.5, XP_586141.3), mouse FRK (NM_001159544.1, NP_034367.2), rat FRK (NM_024368.1, NP_077344.1), and chicken FRK (XM_419779.5, XP_419779.3).

FYN is a member of the protein-tyrosine kinase oncogene family. It encodes a membrane-associated tyrosine kinase that has been implicated in the control of cell growth. The protein associates with the p85 subunit of phosphatidylinositol 3-kinase and interacts with the fyn-binding protein.

Alternatively spliced transcript variants encoding distinct isoforms exist. FYN plays a role in many biological processes including regulation of cell growth and survival, cell adhesion, integrin-mediated signaling, cytoskeletal remodeling, cell motility, immune response and axon guidance. Inactive FYN is phosphorylated on its C-terminal tail within the catalytic domain. Following activation by PKA, the protein subsequently associates with PTK2/FAK1, allowing PTK2/FAK1 phosphorylation, activation and targeting to focal adhesions. FYN is involved in the regulation of cell adhesion and motility through phosphorylation of CTNNB1 (beta-catenin) and CTNND1 (delta-catenin). FYN regulates cytoskeletal remodeling by phosphorylating several proteins including the actin regulator WAS and the microtubule-associated proteins MAP2 and MAPT. FYN promotes cell survival by phosphorylating AGAP2/PIKE-A and preventing its apoptotic cleavage. FYN participates in signal transduction pathways that regulate the integrity of the glomerular slit diaphragm (an essential part of the glomerular filter of the kidney) by phosphorylating several slit diaphragm components including NPHS1, KIRREL and TRPC6. FYN plays a role in neural processes by phosphorylating DPYSL2, a multifunctional adapter protein within the central nervous system, ARHGAP32, a regulator for Rho family GTPases implicated in various neural functions, and SNCA, a small pre-synaptic protein. FYN participates in the downstream signaling pathways that lead to T-cell differentiation and proliferation following T-cell receptor (TCR) stimulation. FYN also participates in negative feedback regulation of TCR signaling through phosphorylation of PAG1, thereby promoting interaction between PAG1 and CSK and recruitment of CSK to lipid rafts. CSK maintains LCK and FYN in an inactive form. FYN promotes CD28-induced phosphorylation of VAV1. Inhibitors of FYN include, but not limited to, Dasatinib, Sprycel, Piceatannol, and 1-Methoxy-2-[2-(2-Methoxy-Ethoxy]-Ethane.

Nucleic acid and polypeptide sequences of FYN are well-known and include, but not limited to, human FYN (NM_002037.5, NP_002028.1), chimp FYN (XM_001159342.5, XP_001159342.1), monkey FYN (XM_015137564.1, XP_014993050.1), dog FYN (XM_849374.3, XP_854467.1), and cow FYN (NM_001077972.1, NP_001071440.1), mouse FYN (NM_008054.2, NP_032080.2), rat FYN (NM_012755.1, NP_036887.1), and chicken FYN (NP_036887.1, NP_990680.2).

LCK is a member of the Src family of protein tyrosine kinases (PTKs). The encoded protein is a key signaling molecule in the selection and maturation of developing T-cells. It contains N-terminal sites for myristylation and palmitylation, a PTK domain, and SH2 and SH3 domains which are involved in mediating protein-protein interactions with phosphotyrosine-containing and proline-rich motifs, respectively. The protein localizes to the plasma membrane and pericentrosomal vesicles, and binds to cell surface receptors, including CD4 and CD8, and other signaling molecules. Multiple alternatively spliced variants, encoding the same protein, have been described. LCK plays an essential role in the selection and maturation of developing T-cells in the thymus and in the function of mature T-cells. LCK plays a key role in T-cell antigen receptor (TCR)-linked signal transduction pathways. LCK is constitutively associated with the cytoplasmic portions of the CD4 and CD8 surface receptors. Association of the TCR with a peptide antigen-bound MHC complex facilitates the interaction of CD4 and CD8 with MHC class II and class I molecules, respectively, thereby recruiting the associated LCK protein to the vicinity of the TCR/CD3 complex. LCK then phosphorylates tyrosines residues within the immunoreceptor tyrosine-based activation motifs (ITAM) of the cytoplasmic tails of the TCR-gamma chains and CD3 subunits, initiating the TCR/CD3 signaling pathway. Once stimulated, the TCR recruits the tyrosine kinase ZAP70 that becomes phosphorylated and activated by LCK. Following this, a large number of signaling molecules are recruited, ultimately leading to lymphokine production. LCK also contributes to signaling by other receptor molecules. LCK associates directly with the cytoplasmic tail of CD2, which leads to hyperphosphorylation and activation of LCK. LCK also plays a role in the IL2 receptor-linked signaling pathway that controls the T-cell proliferative response. Binding of IL2 to its receptor results in increased activity of LCK. LCK is expressed at all stages of thymocyte development and is required for the regulation of maturation events that are governed by both pre-TCR and mature alpha beta TCR. LCK phosphorylates other substrates including RUNX3, PTK2B/PYK2, the microtubule-associated protein MAPT, RHOH or TYROBP. Inhibitors of LCK include, but not limited to, Dasatinib, Nintedanib, ponatinib, Pazopanib, and Iclusig.

Nucleic acid and polypeptide sequences of LCK are well-known and include, but not limited to, human LCK (NM_001042771.2, NP_005347.3), chimp LCK (XM_016958271.1, XP_016813760.1), dog LCK (XM_005617639.1, XP_005617696.1), cow LCK (NM_001034334.1, NP_001029506.1), mouse LCK (NM_001162432.1, NP_034823.1), rat LCK (NM_001100709.1, NP_001094179.1), and chicken LCK (XM_015297854.1, XP_427615.3).

LYN encodes a tyrosine protein kinase, which may be involved in the regulation of mast cell degranulation, and erythroid differentiation. Alternatively spliced transcript variants encoding different isoforms have been found for this gene. LYN transmits signals from cell surface receptors and plays an important role in the regulation of innate and adaptive immune responses, hematopoiesis, responses to growth factors and cytokines, integrin signaling, but also responses to DNA damage and genotoxic agents. LYN functions primarily as negative regulator, but can also function as activator, depending on the context. LYN is required for the initiation of the B-cell response, but also for its down-regulation and termination. LYN plays an important role in the regulation of B-cell differentiation, proliferation, survival and apoptosis, and is important for immune self-tolerance. LYN acts downstream of several immune receptors, including the B-cell receptor, CD79A, CD79B, CD5, CD19, CD22, FCER1, FCGR2, FCGR1A, TLR2 and TLR4. LYN plays a role in the inflammatory response to bacterial lipopolysaccharide. LYN mediates the responses to cytokines and growth factors in hematopoietic progenitors, platelets, erythrocytes, and in mature myeloid cells, such as dendritic cells, neutrophils and eosinophils. LYN acts downstream of EPOR, KIT, MPL, CXCR4, IL3 receptor, IL5 receptor, and CSF2 receptor. LYN plays an important role in integrin signaling. LYN regulates cell proliferation, survival, differentiation, migration, adhesion, degranulation, and cytokine release. LYN down-regulates signaling pathways by phosphorylation of immunoreceptor tyrosine-based inhibitory motifs (ITIM), that then serve as binding sites for phosphatases, such as PTPN6/SHP-1, PTPN11/SHP-2 and INPP5D/SHIP-1, that modulate signaling by dephosphorylation of kinases and their substrates. LYN phosphorylates LIME1 in response to CD22 activation. LYN phosphorylates BTK, CBL, CD5, CD19, CD72, CD79A, CD79B, CSF2RB, DOK1, HCLS1, LILRB3/PIR-B, MS4A2/FCER1B, PTK2B/PYK2, SYK and TEC. LYN promotes phosphorylation of SIRPA, PTPN6/SHP-1, PTPN11/SHP-2 and INPP5D/SHIP-1. LYN mediates phosphorylation of the BCR-ABL fusion protein. LYN is required for rapid phosphorylation of FER in response to FCER1 activation. LYN mediates KIT phosphorylation. LYN acts as an effector of EPOR (erythropoietin receptor) in controlling KIT expression and may play a role in erythroid differentiation during the switch between proliferation and maturation. Depending on the context, LYN activates or inhibits several signaling cascades. LYN regulates phosphatidylinositol 3-kinase activity and activation. LYN regulates activation of the MAP kinase signaling cascade, including activation of MAP2K1/MEK1, MAPK1/ERK2, MAPK3/ERK1, MAPK8/JNK1 and MAPK9/JNK2. LYN mediates activation of STAT5A and/or STAT5B. LYN phosphorylates LPXN on Tyr-72. LYN kinase activity facilitates TLR4-TLR6 heterodimerization and signal initiation. Inhibitors of LYN include, but not limited to, bosutinib, Nintedanib, ponatinib, Bosulif, and Iclusig.

Nucleic acid and polypeptide sequences of LYN are well-known and include, but not limited to, human LYN (NM_002350.3, NP_002341.1), chimp LYN (XM_016959500.1, XP_528143.2), monkey LYN (XM_001087049.3, XP_001087049.2), dog LYN (XM_005637999.1, XP_535078.2), cow LYN (NM_001177740.1, NP_001171211.1), mouse LYN (NM_010747.2, NP_034877.2), rat LYN (NM_001111098.1, NP_110484.1), and chicken LYN (NM_001006390.1, NP_001006390.1).

YES1 is the cellular homolog of the Yamaguchi sarcoma virus oncogene. The encoded protein has tyrosine kinase activity and belongs to the src family of proteins. This gene lies in close proximity to thymidylate synthase gene on chromosome 18, and a corresponding pseudogene has been found on chromosome 22. YES1 is involved in the regulation of cell growth and survival, apoptosis, cell-cell adhesion, cytoskeleton remodeling, and differentiation. Stimulation by receptor tyrosine kinases (RTKs) including EGRF, PDGFR, CSF1R and FGFR leads to recruitment of YES1 to the phosphorylated receptor, and activation and phosphorylation of downstream substrates. Upon EGFR activation, YES1 promotes the phosphorylation of PARD3 to favor epithelial tight junction assembly. YES1 participates in the phosphorylation of specific junctional components such as CTNND1 by stimulating the FYN and FER tyrosine kinases at cell-cell contacts. Upon T-cell stimulation by CXCL12, YES1 phosphorylates collapsin response mediator protein 2/DPYSL2 and induces T-cell migration. YES1 participates in CD95L/FASLG signaling pathway and mediates AKT-mediated cell migration. YES1 plays a role in cell cycle progression by phosphorylating the cyclin-dependent kinase 4/CDK4 thus regulating the G1 phase. YES1 is also involved in G2/M progression and cytokinesis. Inhibitors of YES1 include, but not limited to, Dasatinib, Sprycel, AT9283, and ENMD-2076.

Nucleic acid and polypeptide sequences of YES1 are well-known and include, but not limited to, human YES1 (NM_005433.3), chimp YES1 (XM_001148240.3, XP_001148240.1), monkey YES1 (NM_001257512.1, NP_001244441.1), dog YES1 (NM_001003239.2, NP_001003239.2), cow YES1 (NM_001101060.1, NP_001094530.1), mouse YES1 (NM_009535.3, NP_033561.1), rat YES1 (NM_033298.1, NP_150640.1), and chicken YES1 (NM_205301.1, NP_990632.1).

KLRF1, an activating homodimeric C-type lectin-like receptor (CTLR), is expressed on nearly all natural killer (NK) cells and stimulates their cytoxicity and cytokine release (Kuttruff et al., (2009) Blood 113: 358-369). FACS and surface plasmon resonance analyses showed that AICL (CLEC2B), a myeloid cell-specific receptor, interacted with NKp80 at an intermediate on rate and a rapid off rate. AICL expression was upregulated by a number of Toll-like receptor (TLR) ligands, but not by TLR9 ligands. Welte et al. (2006) Nature Immun. 7: 1334-1342 concluded that AICL is a ligand for the activating NK receptor NKp80 and that NKp80-AICL interaction induces cytolysis of myeloid cells and activation of both NK cells and monocytes. They noted that both molecules are present in humans but not in rodents.

Using gene expression profiling and FACS analysis, Kuttruff et al., (2009) Blood 113: 358-369 showed that NKp80 was expressed on a small but highly responsive subset of effector memory CD8-positive T cells with an inflammatory NK-like phenotype and that NKp80 promoted T-cell responses toward AICL-expressing cells. Nucleic acid and polypeptide sequences of KLRF1 are well-known and include, but not limited to, human KLRF1 (NM_001291823.1, NP_057607.1), chimp KLRF1 (NM_001079918.1, NP_001073387.1), monkey KLRF1 (NM_001032961.1, NP_001028133.1), dog KLRF1 (XM_849098.2, XP_854191.2), and cow KLRF1 (NM_001099120.2, NP_001092590.1).

STK33 is a serine/threonine protein kinase which phosphorylates VIME. STK33 may play a specific role in the dynamic behavior of the intermediate filament cytoskeleton by phosphorylation of VIME (By similarity). STK22 does not appear to be essential for the survival of KRAS-dependent AML cell lines. Mutations in the KRAS gene are responsible for oncogenic cell growth in a wide range of human cancers. Using an RNA interference screen, Scholl et al. (2009) Cell 137: 821-834 found that STK33 was essential for abnormal cell growth in human cell lines expressing oncogenic mutations in KRAS, but not in human cancer cell lines expressing wildtype KRAS. Knockdown of STK33 in mutant KRAS-dependent cell lines via small interfering RNA (siRNA) decreased phosphorylation of S6K1 (RPS6KB1) and the S6K1 substrate RPS6, and it induced expression of genes involved in the mitochondrial apoptotic pathway, including BAD, which encodes a proapoptotic protein. Knockdown of BAD via siRNA rescued cell viability after STK33 suppression in KRAS-dependent cell lines. Knockdown of STK33 in cancer cell lines expressing wildtype KRAS had no effect on cell growth or apoptotic signaling. Scholl et al. (2009) Cell 137: 821-834concluded that STK33 is required for survival and proliferation of mutant KRAS-dependent cancer cells, in which it suppresses the S6K1-BAD proapoptotic signaling pathway.

Nucleic acid and polypeptide sequences of STK33 are well-known and include, but not limited to, human STK33 (NM_030906.3, NP_112168.1), chimp STK33 (XM_009459902.2, XP_009458177.2), monkey STK33 (XM_015114926.1, XP_014970412.1), dog STK33 (XM_534045.4, XP_534045.3), and cow STK33 (NM_001075908.1, NP_001069376.1), mouse STK33 (NM_054103.1, NP_473444.1), and rat STK22 (XM_008774641.1, XP_008772863.1).

EPHB2 is a member of the Eph receptor family of receptor tyrosine kinase transmembrane glycoproteins. These receptors are composed of an N-terminal glycosylated ligand-binding domain, a transmembrane region and an intracellular kinase domain. They bind ligands called ephrins and are involved in diverse cellular processes including motility, division, and differentiation. A distinguishing characteristic of Eph-ephrin signaling is that both receptors and ligands are competent to transduce a signaling cascade, resulting in bidirectional signaling. This protein belongs to a subgroup of the Eph receptors called EphB. Proteins of this subgroup are distinguished from other members of the family by sequence homology and preferential binding affinity for membrane-bound ephrin-B ligands. Allelic variants are associated with prostate and brain cancer susceptibility. Alternative splicing of the EPHB2 gene results in multiple transcript variants.

EPHB2 binds promiscuously transmembrane ephrin-B family ligands residing on adjacent cells, leading to contact-dependent bidirectional signaling into neighboring cells. The signaling pathway downstream of the receptor is referred to as forward signaling while the signaling pathway downstream of the ephrin ligand is referred to as reverse signaling. EPHB2 functions in axon guidance during development. EPHB2 is involved in the guidance of commissural axons that form a major interhemispheric connection between the 2 temporal lobes of the cerebral cortex. EPHB2 is also involved in guidance of contralateral inner ear efferent growth cones at the midline and of retinal ganglion cell axons to the optic disk. In addition to axon guidance, EPHB2 also regulates dendritic spines development and maturation and stimulates the formation of excitatory synapses. Upon activation by EFNB1, EPHB2 abolishes the ARHGEF15-mediated negative regulation on excitatory synapse formation. EPHB2 controls other aspects of development including angiogenesis, palate development and in inner ear development through regulation of endolymph production. Forward and reverse signaling through the EFNB2/EPHB2 complex regulate movement and adhesion of cells that tubularize the urethra and septate the cloaca. EPHB2 may also function as a tumor suppressor.

Nucleic acid and polypeptide sequences of EPHB2 are well-known and include, but not limited to, human EPHB2 (NM_004442.7, NP_004433.2), chimp EPHB2 (XM_016956064.1, XP_016811553.1), chicken EPHB2 (NM_206951.3, NP_996834.1), mouse (NM_010142.4, NP_034272.1), dog EPHB2 (XM_005617823.2, XP_005617880.1), rat EPHB2 (NM_001127319.1, NP_001120791.1), and cow EPHB2 (NM_001191498.1, NP_001178427.1).

GABRA4 is the major inhibitory neurotransmitter in the mammalian brain where it acts at GABA-A receptors, which are ligand-gated chloride channels. Chloride conductance of these channels can be modulated by agents such as benzodiazepines that bind to the GABA-A receptor. At least 16 distinct subunits of GABA-A receptors have been identified. This gene encodes subunit alpha-4, which is involved in the etiology of autism and eventually increases autism risk through interaction with another subunit, gamma-aminobutyric acid receptor beta-1 (GABRB1). Alternatively spliced transcript variants encoding different isoforms have been found in this gene. GABA, the major inhibitory neurotransmitter in the vertebrate brain, mediates neuronal inhibition by binding to the GAB A/benzodiazepine receptor and opening an integral chloride channel GABAA receptors are members of the Cys-loop family of ligand-gated ion channels and, along with GABAB receptors, are responsible for mediating the inhibitory effects of GABA. They are pentameric proteins, consisting of five subunits belonging to different families GABRA4 inhibitors include, but not limitd to, Bromazepam, Butabarbital, Butalbital, Butethal 2, and Chlordiazepoxide.

GABRA4 Nucleic acid and polypeptide sequences of GABRA4 are well-known and include, but not limited to, human GABRA4 (NM_000809.3, NP_000800.2), chimp GABRA4 (XM_526774.5, XP_526774.2), mouse GABRA4 (NM_010251.2, NP_034381.1), monkey GABRA4 (XM_001101231.3, XP_001101231.1), dog GABRA4 (XM_014118665.1, XP_013974140.1), rat GABRA4 (NM_080587.3, NP_542154.3), chicken GABRA4 (XM_004936058.2, XP_420724.2), and cow GABRA4 (NM_174543.2, NP_776968.1).

PI4K2A phosphorylates PtdIns at the D-4 position, an essential step in the biosynthesis of Phosphatidylinositolpolyphosphates (PtdInsPs) (Barylko et al. (2001) *J Biol Chem.* 2001 276(11):7705-8). PtdInsPs are centrally involved in many biologic processes, ranging from cell growth and organization of the actin cytoskeleton to endo- and exocytosis. PI4K2A is a membrane-bound phosphatidylinositol-4 kinase (PI4-kinase) that catalyzes the phosphorylation of phosphatidylinositol (PI) to phosphatidylinositol 4-phosphate (PI4P), a lipid that plays important roles in endocytosis, Golgi function, protein sorting and membrane trafficking. PI4K2A is required for prolonged survival of neurons. Phosphorylation of phosphatidylinositol (PI) to phosphatidylinositol 4-phosphate (PI4P) is the first committed step in the generation of phosphatidylinositol 4,5-bisphosphate (PIP2), a precursor of the second messenger inositol 1,4,5-trisphosphate (InsP3).

Nucleic acid and polypeptide sequences of PI4K2A are well-known and include, but not limited to, human PI4K2A (NM_018425.3, NP_060895.1), chimp PI4K2A (XM_507965.4, XP_507965.2), mouse PI4K2A (NM_145501.2 NP_663476.1), dog PI4K2A (XM_543953.5, XP_543953.2), rat PI4K2A (NM_053735.1, NP_446187.1), chicken PI4K2A (XM_423069.5, XP_423069.1), and cow PI4K2A (NM_001100316.1, NP_001093786.1).

PIK3R2 is a lipid kinase that phosphorylates phosphatidylinositol and similar compounds, creating second messengers important in growth signaling pathways. PI3K functions as a heterodimer of a regulatory and a catalytic subunit. The protein encoded by this gene is a regulatory component of PI3K. Two transcript variants, one protein coding and the other non-protein coding, have been found for this gene. PIK3R2 is the regulatory subunit of phosphoinositide-3-kinase (PI3K), a kinase that phosphorylates PtdIns(4,5)P2 (Phosphatidylinositol 4,5-bisphosphate) to generate phosphatidylinositol 3,4,5-trisphosphate (PIP3). PIP3 plays a key role by recruiting PH domain-containing proteins to the membrane, including AKT1 and PDPK1, activating signaling cascades involved in cell growth, survival, proliferation, motility and morphology. PIK3R2 binds to activated (phosphorylated) protein-tyrosine kinases, through its SH2 domain, and acts as an adapter, mediating the association of the p110 catalytic unit to the plasma membrane. PIK3R2 indirectly regulates autophagy (Kuchay et al. (2013) *Nat Cell Biol* 15(5):472-480). PIK3R2 promotes nuclear translocation of XBP1 isoform 2 in an ER stress- and/or insulin-dependent manner during metabolic overloading in the liver and hence plays a role in glucose tolerance improvement. PIK3R2 inhibitors include, but not limited to, GSK2636771, SF1126, XL147, Isoproterenol, and Quercetin.

Nucleic acid and polypeptide sequences of PIK3R2 are well-known and include, but not limited to, human PIK3R2 (NM_005027.3, NP_005018.1), chimp PIK3R2 (XM_512509.4, XP_512509.2), monkey PIK3R2 (NM_001258052.1, NP_001244981.1), dog PIK3R2 (XM_847313.4, XP_852406.2), cow PIK3R2

(NM_174576.2, NP_777001.1), mouse PIK3R2 (NM_008841.2, NP_032867.2), rat PIK3R2 (NM_022185.2, NP_071521.2), and chicken PIK3R2 (XM_001233340.4, XP_001233341.3).

CHRNA1 encodes an alpha subunit that plays a role in acetlycholine binding/channel gating. Alternatively spliced transcript variants encoding different isoforms have been identified. The muscle acetylcholine receptor consists of 5 subunits of 4 different types: 2 alpha subunits and 1 each of the beta, gamma, and delta subunits. After binding acetylcholine, the AChR responds by an extensive change in conformation that affects all subunits and leads to opening of an ion-conducting channel across the plasma membrane. Inhibitors of CHRNA1 include, but not limited to, Mecamylamine, Pancuronium, Succinylcholine, Galantamine, and Acetylcysteine.

Nucleic acid and polypeptide sequences of CHRNA1 are well-known and include, but not limited to, human CHRNA1 (NM_001039523.2, NP_000070.1), chimp CHRNA1 (XM_016950066.1, XP_016805555.1), monkey CHRNA1 (XM_001091711.3, XP_001091711.1), dog CHRNA1 (NM_001003144.2, NP_001003144.1), mouse CHRNA1 (NM_007389.5, NP_031415.2), rat CHRNA1 (NM_024485.1, NP_077811.1), chicken CHRNA1 (NM_204816.1, NP_990147.1), and cow CHRNA1 (NM_176664.2, NP_788837.1).

NAGPA encodes the enzyme that catalyzes the second step in the formation of the mannose 6-phosphate recognition marker on lysosomal hydrolases. Hydrolases are transported to lysosomes after binding to mannose 6-phosphate receptors in the trans-Golgi network. Commonly known as 'uncovering enzyme' or UCE, this enzyme removes N-acetyl-D-glucosamine (GlcNAc) residues from GlcNAc-alpha-P-mannose moieties and thereby produces the recognition marker. The encoded preproprotein is proteolytically processed by furin to generate the mature enzyme, a homotetramer of two disulfide-linked homodimers. Mutations in this gene are associated with developmental stuttering in human patients. NAGPA catalyzes the second step in the formation of the mannose 6-phosphate targeting signal on lysosomal enzyme oligosaccharides by removing GlcNAc residues from GlcNAc-alpha-P-mannose moieties, which are formed in the first step. NAGPA also hydrolyzes UDP-GlcNAc, a sugar donor for Golgi N-acetylglucosaminyl-transferases.

Nucleic acid and polypeptide sequences of NAGPA are well-known and include, but not limited to, human NAGPA (NM_016256.3, NP_057340.2), chimp NAGPA (XM_510795.6, XP_510795.2), monkey NAGPA (XM_001100122.3, XP_001100122.1), dog NAGPA (XM_005621579.2, XP_005621636.1), cow NAGPA (NM_001206618.1, NP_001193547.1), mouse NAGPA (NM_013796.3, NP_038824.2), rat NAGPA (NM_001108265.1, NP_001101735.1), and chicken NAGPA (XM_414709.5, XP_414709.4).

PCDHB15 is a member of the protocadherin beta gene cluster, one of three related gene clusters tandemly linked on chromosome five. The gene clusters demonstrate an unusual genomic organization similar to that of B-cell and T-cell receptor gene clusters. The beta cluster contains 16 genes and 3 pseudogenes, each encoding 6 extracellular cadherin domains and a cytoplasmic tail that deviates from others in the cadherin superfamily. The extracellular domains interact in a homophilic manner to specify differential cell-cell connections. Unlike the alpha and gamma clusters, the transcripts from these genes are made up of only one large exon, not sharing common 3' exons as expected. These neural cadherin-like cell adhesion proteins are integral plasma membrane proteins. Their specific functions are unknown but they most likely play a critical role in the establishment and function of specific cell-cell neural connections. PCDHB15 may be a potential calcium-dependent cell-adhesion protein. PCDHB15 may be involved in the establishment and maintenance of specific neuronal connections in the brain.

Nucleic acid and polypeptide sequences of PCDHB15 are well-known and include, but not limited to, human PCDHB15 (NM_018935.3, NP_061758.1), chimp PCDHB15 (NM_001013011.2, NP_001013029.1), monkey PCDHB15 (XM_001092245.3, XP_001092245.1), dog PCDHB15 (XM_005617297.2, XP_005617354.1), mouse PCDHB15 (NM_053147.3, NP_444377.3), and rat PCDHB15 (XM_001065549.5, XP_001056235.1).

UPRT encodes uracil phosphoribosyltransferase, which catalyzes the conversion of uracil and 5-phosphoribosyl-1-R-diphosphate to uridine monophosphate (UMP). This reaction is an important part of nucleotide metabolism, specifically the pyrimidine salvage pathway. The enzyme localizes to the nucleus and cytoplasm. The protein is a potential target for rational design of drugs to treat parasitic infections and cancer. Inhibitors for UPRT include, but not limited to, Orphenadrine, Meperidine, Phenobarbital, and Acamprosate.

Nucleic acid and polypeptide sequences of UPRT are well-known and include, but not limited to, human UPRT (NM_145052.3, NP_659489.1), chimp UPRT (XM_521142.5, XP_521142.2), monkey UPRT (NM_001261749.1, NP_001248678.1), dog UPRT (XM_538081.4, XP_538081.2), cow UPRT (NM_001076245.2, NP_001069713.1), mouse UPRT (NM_001081189.1, NP_001074658.1), rat UPRT (XM_006227407.2, XP_228538.3), and chicken UPRT (NM_001031124.1, NP_001026295.1).

GRIN1 is a critical subunit of N-methyl-D-aspartate receptors, members of the glutamate receptor channel superfamily which are heteromeric protein complexes with multiple subunits arranged to form a ligand-gated ion channel. These subunits play a key role in the plasticity of synapses, which is believed to underlie memory and learning. Cell-specific factors are thought to control expression of different isoforms, possibly contributing to the functional diversity of the subunits. Alternatively spliced transcript variants have been described.

Nucleic acid and polypeptide sequences of GRIN1 are well-known and include, but not limited to, human GRIN1 (NM_000832.6, NP_067544.1), monkey GRIN1 (XM_015116264.1, XP_014971750.1), dog GRIN1 (NM_001008717.1, NP_001008717.1), cow GRIN1 (XM_015473721.1, XP_015329207.1), mouse GRIN1 (NM_001177657.2, NP_032195.1), rat GRIN1 (NM_001270602.1, NP_058706.1), and chicken GRIN1 (NM_206979.1, NP_996862.1).

PTPN2 is a member of the protein tyrosine phosphatase (PTP) family Members of the PTP family share a highly conserved catalytic motif, which is essential for the catalytic activity. PTPs are known to be signaling molecules that regulate a variety of cellular processes including cell growth, differentiation, mitotic cycle, and oncogenic transformation. Epidermal growth factor receptor and the adaptor protein Shc were reported to be substrates of this PTP, which suggested the roles in growth factor mediated cell signaling. Multiple alternatively spliced transcript variants encoding different isoforms have been found. Two highly related but distinctly processed pseudogenes that localize to chromosomes 1 and 13, respectively, have been reported. PTPN2 dephosphorylates receptor protein tyrosine kinases including INSR, EGFR, CSF1R, and PDGFR. PTPN2 also dephosphorylates non-receptor protein tyrosine kinases like JAK1, JAK2, JAK3, Src family kinases, STAT1, STAT3, STAT5A, STAT5B and STAT6 either in the nucleus or the cytoplasm. PTPN2 negatively regulates numerous signaling pathways and biological processes like hematopoiesis, inflammatory response, cell proliferation and differentiation, and glucose homeostasis. PTPN2 plays a multifaceted and important role in the development of the immune system. PTPN2 functions in T-cell receptor signaling through dephosphorylation of FYN and LCK to control T-cells differentiation and activation.

PTPN2 dephosphorylates CSF1R, negatively regulating its downstream signaling and macrophage differentiation. PTPN2 negatively regulates cytokine (IL2/interleukin-2 and interferon)-mediated signaling through dephosphorylation of the cytoplasmic kinases JAK1, JAK3 and their substrate STAT1, that propagate signaling downstream of the cytokine receptors. PTPN2 also regulates the IL6/interleukin-6 and IL4/interleukin-4 cytokine signaling through dephosphorylation of STAT3 and STAT6 respectively. In addition to the immune system, it is involved in anchorage-dependent, negative regulation of EGF-stimulated cell growth. Activated by the integrin ITGA1/ITGB1, it dephosphorylates EGFR and negatively regulates EGF signaling. PTPN2 dephosphorylates PDGFRB and negatively regulates platelet-derived growth factor receptor-beta signaling pathway and therefore cell proliferation. PTPN2 negatively regulates tumor necrosis factor-mediated signaling downstream via MAPK through SRC dephosphorylation. PTPN2 may also regulate the hepatocyte growth factor receptor signaling pathway through dephosphorylation of the hepatocyte growth factor receptor MET. PTPN2 plays also an important role in glucose homeostasis. For instance, PTPN2 negatively regulates the insulin receptor signaling pathway through the dephosphorylation of INSR and control gluconeogenesis and liver glucose production through negative regulation of the IL6 signaling pathways. Finally, it negatively regulates prolactin-mediated signaling pathway through dephosphorylation of STAT5A and STAT5B. PTPN2 may also bind DNA. Nucleic acid and polypeptide sequences of PTPN2 are well-known and include, but not limited to, human PTPN2 (NG_029116, NP_001295216.1, NP_001193942.1, NP_002819.2, NP_536348.1, NP_536347.1), chimp PTPN2 (XM_009433613.2, XM_009433614.2, XM_009433615.2, XM_003953237.2, XM_001171536.4, XP_009431892.1, XP_009431888.2, XP_009431889.2, XP_009431890.2, XP_003953286.2), mouse PTPN2 (NM_008977.3, NM_001127177.1, NP_001120649.1, NP_033003.1), and rat PTPN2 (NM_053990.1, NP_446442.1).

STAT3 is a member of the STAT protein family. In response to cytokines and growth factors, STAT family members are phosphorylated by the receptor associated kinases, and then form homo- or heterodimers that translocate to the cell nucleus where they act as transcription activators. This protein is activated through phosphorylation in response to various cytokines and growth factors including IFNs, EGF, IL5, IL6, HGF, LIF and BMP2. STAT3 mediates the expression of a variety of genes in response to cell stimuli, and thus plays a key role in many cellular processes such as cell growth and apoptosis. The small GTPase Rac1 has been shown to bind and regulate the activity of this protein. PIAS3 protein is a specific inhibitor of this protein. Mutations in STAT3 are associated with infantile-onset multisystem autoimmune disease and hyper-immunoglobulin E syndrome. Alternative splicing of the STAT3 gene results in multiple transcript variants encoding distinct isoforms. STAT3 is a signal transducer and transcription activator that mediates cellular responses to interleukins, KITLG/SCF, LEP and other growth factors. Once activated, recruits coactivators, such as NCOA1 or MED1, to the promoter region of the target gene (Saxena et al. (2007) *J. Biol Chem* 282(18):13316-25). STAT3 may mediate cellular responses to activated FGFR1, FGFR2, FGFR3 and FGFR4. STAT3 binds to the interleukin-6 (IL-6)-responsive elements identified in the promoters of various acute-phase protein genes. STAT3 is activated by IL31 through IL31RA. STAT3 is involved in cell cycle regulation by inducing the expression of key genes for the progression from G1 to S phase, such as CCND1 (Saxena et al. (2007) *J. Biol Chem* 282(18):13316-25). STAT3 mediates the effects of LEP on melanocortin production, body energy homeostasis and lactation (By similarity). STAT3 may play an apoptotic role by transctivating BIRC5 expression under LEP activation (Jiang et al. (2008) *Biochem Biophys Res Commun.* 368(1):1-5). Cytoplasmic STAT3 represses macroautophagy by inhibiting EIF2AK2/PKR activity. Inhibitors of STAT3 include, but not limited to, guanosine triphophosphate, and Ethambutol, Isoniazid, Pyrazinamide, Rifampicin, and Streptomycin. Nucleic acid and polypeptide sequences of STAT3 are well-known and include, but not limited to, human STAT3 (NM_139276.2, NM_003150.3, NM_213662.1, NP_003141.2, NP_644805.1, NP_998827.1), monkey STAT3 (XM_015119695.1, XP_014975181.1), mouse STAT3 (NM_213659.3, NM_213660.3, NM_011486.5, NP_035616.1, NP_998824.1, NP_998825.1), and rat STAT3 (NM_012747.2, NP_036879.1).

HCK is a member of the Src family of tyrosine kinases. This protein is primarily hemopoietic, particularly in cells of the myeloid and B-lymphoid lineages. It may help couple the Fc receptor to the activation of the respiratory burst. In addition, it may play a role in neutrophil migration and in the degranulation of neutrophils. Multiple isoforms with different subcellular distributions are produced due to both alternative splicing and the use of alternative translation initiation codons, including a non-AUG (CUG) codon. HCK is found in hematopoietic cells that transmits signals from cell surface receptors and plays an important role in the regulation of innate immune responses, including neutrophil, monocyte, macrophage and mast cell functions, phagocytosis, cell survival and proliferation, cell adhesion and migration. HCK acts downstream of receptors that bind the Fc region of immunoglobulins, such as FCGR1A and FCGR2A, but also CSF3R, PLAUR, the receptors for IFNG, IL2, IL6 and IL8, and integrins, such as ITGB1 and ITGB2. During the phagocytic process, HCK mediates mobilization of secretory lysosomes, degranulation, and activation of NADPH oxidase to bring about the respiratory burst. HCK plays a role in the release of inflammatory molecules. HCK promotes reorganization of the actin cytoskeleton and actin polymerization, formation of podosomes and cell protrusions. HCK inhibits TP73-mediated transcription activation and TP73-mediated apoptosis. HCK phosphorylates CBL in response to activation of immunoglobulin gamma Fc region receptors. HCK phosphorylates ADAM15, BCR, ELMO1, FCGR2A, GAB1, GAB2, RAPGEF1, STATSB, TP73, VAV1 and WAS. Inhibitors of HCK include, but not limited to, bosutinib, Bosulif, 1-Ter-Butyl-3-P-Tolyl-1h-Pyrazolo[3,4-D]Pyrimidin-4-Ylamine, 0-Phosphotyrosine, and Adenosine triphosphate. Nucleic acid and polypeptide sequences of HCK are well-known and include, but not limited to, human HCK (NM_002110.3, NM_001172129.1, NM_001172130.1, NM_001172131.1, NM_001172132.1, NM_001172133.1, NP_002101.2, NP_001165600.1, NP_001165601.1, NP_001165602.1, NP_001165603.1, NP_001165604.1), monkey HCK (XM_015149268.1, XM_015149269.1, XP_015004754.1, XP_015004755.1), mouse HCK (NM_010407.4, NM_001172117.1, NP_034537.2, NP_001165588.1), and rat HCK (NM_013185.3, NP_037317.2).

NCK1 is one of the signaling and transforming proteins containing Src homology 2 and 3 (SH2 and SH3) domains. It is located in the cytoplasm and is an adaptor protein involved in transducing signals from receptor tyrosine kinases to downstream signal recipients such as RAS. Alternatively spliced transcript variants encoding different isoforms have been found. NCK1 is an adapter protein which associates with tyrosine-phosphorylated growth factor receptors, such as KDR and PDGFRB, or their cellular substrates. NCK1 maintains low levels of EIF2S1 phosphorylation by promoting its dephosphorylation by PP1. NCK1 plays a role in the DNA damage response, not in the detection of the damage by ATM/ATR, but for efficient activation of downstream effectors, such as that of CHEK2. NCK1 plays a role in ELK1-dependent transcriptional activation in response to activated Ras signaling. NCK1 modulates the activation of EIF2AK2/PKR by dsRNA. NCK1 may play a role in cell adhesion and migration through interaction with ephrin receptors. Nucleic acid and polypeptide sequences of NCK1 are well-known and include, but not limited to, human NCK1 (NM_006153.5, NM_001291999.1, NM_001190796.2, NP_006144.1, NP_001177725.1, NP_001278928.1), monkey NCK1 ( ), mouse NCK1 (NM_010878.3, NM_001324530.1, NP_035008.2, NP_001311459.1), and rat NCK1 (NM_001106851.2, NP_001100321.1).

JAK1 is a membrane protein that is a member of a class of protein-tyrosine kinases (PTK) characterized by the presence of a second phosphotransferase-related domain immediately N-terminal to the PTK domain. The encoded kinase phosphorylates STAT proteins (signal transducers and activators of transcription) and plays a key role in interferon-alpha/beta and interferon-gamma signal transduction. Alternative splicing of the JAK1 gene results in multiple transcript variants. JAK2 is a tyrosine kinase of the non-receptor type, involved in the IFN-alpha/beta/gamma signal pathway (Sakatsume et al. (1995) *J. Biol. Chem* 270(29): 17528-34). JAK1 is a kinase partner for the interleukin (IL)-2 receptor (Simoncic et al. (1995) *Curr Biol* 12(6); 446-53). Inhibitors of JAK2 include, but not limited to, ruxolitinib, Adenosine triphosphate, 2-(1,1-DIMETHYL-ETHYL)9-FLUORO-3,6-DIHYDRO-7H-BENZ[H]-IMI-DAZ[4,5-F]ISOQUINOLIN-7-ONE, 3-{(3R,4R)-4-methyl-3-[methyl(7H-pyrrolo[2,3-d]pyrimidin-4-yl)amino] piperidin-1-yl}-3-oxopropanenitrile, and Tofacitinib. Nucleic acid and polypeptide sequences of JAK1 are well-known and include, but not limited to, human JAK1 (NM_001320923.1, NM_001321856.1, NM_001321853.1, NM_001321854.1, NP_002218.2, NP_001307852.1, NP_001308785.1, NP_001308782.1), monkey JAK1 (NM_001257909.1, NP_001244838.1), mouse JAK1 (NM_146145.2, NP_666257.2), and rat JAK1 (NM_053466.1, NP_445918.1).

SRC is highly similar to the v-src gene of Rous sarcoma virus. This proto-oncogene may play a role in the regulation of embryonic development and cell growth. The protein encoded by this gene is a tyrosine-protein kinase whose activity can be inhibited by phosphorylation by c-SRC kinase. Mutations in this gene could be involved in the malignant progression of colon cancer. Two transcript variants encoding the same protein have been found for this gene. SRC is a non-receptor protein tyrosine kinase which is activated following engagement of many different classes of cellular receptors including immune response receptors, integrins and other adhesion receptors, receptor protein tyrosine kinases, G protein-coupled receptors as well as cytokine receptors. SRC participates in signaling pathways that control a diverse spectrum of biological activities including gene transcription, immune response, cell adhesion, cell cycle progression, apoptosis, migration, and transformation. Due to functional redundancy between members of the SRC kinase family, identification of the specific role of each SRC kinase is very difficult. SRC appears to be one of the primary kinases activated following engagement of receptors and plays a role in the activation of other protein tyrosine kinase (PTK) families Receptor clustering or dimerization leads to recruitment of SRC to the receptor complexes where it phosphorylates the tyrosine residues within the receptor cytoplasmic domains. SRC plays an important role in the regulation of cytoskeletal organization through phosphorylation of specific substrates such as AFAP1. Phosphorylation of AFAP1 allows the SRC SH2 domain to bind AFAP1 and to localize to actin filaments. Cytoskeletal reorganization is also controlled through the phosphorylation of cortactin (CTTN). When cells adhere via focal adhesions to the extracellular matrix, signals are transmitted by integrins into the cell resulting in tyrosine phosphorylation of a number of focal adhesion proteins, including PTK2/FAK1 and paxillin (PXN). In addition to phosphorylating focal adhesion proteins, SRC is also active at the sites of cell-cell contact adherens junctions and phosphorylates substrates such as beta-catenin (CTNNB1), delta-catenin (CTNND1), and plakoglobin (JUP). Another type of cell-cell junction, the gap junction, is also a target for SRC, which phosphorylates connexin-43 (GJA1). SRC is implicated in regulation of pre-mRNA-processing and phosphorylates RNA-binding proteins such as KHDRBS1. SRC also plays a role in PDGF-mediated tyrosine phosphorylation of both STAT1 and STAT3, leading to increased DNA binding activity of these transcription factors. SRC is involved in the RAS pathway through phosphorylation of RASA1 and RASGRF1. SRC plays a role in EGF-mediated calcium-activated chloride channel activation. SRC is required for epidermal growth factor receptor (EGFR) internalization through phosphorylation of clathrin heavy chain (CLTC and CLTCL1) at Tyr-1477. SRC is involved in beta-arrestin (ARRB1 and ARRB2) desensitization through phosphorylation and activation of ADRBK1, leading to beta-arrestin phosphorylation and internalization. SRC has a critical role in the stimulation of the CDK20/MAPK3 mitogen-activated protein kinase cascade by epidermal growth factor. SRC might be involved not only in mediating the transduction of mitogenic signals at the level of the plasma membrane, but also in controlling progression through the cell cycle via interaction with regulatory proteins in the nucleus. SRC plays an important role in osteoclastic bone resorption in conjunction with PTK2B/PYK2. Both the formation of a SRC-PTK2B/PYK2 complex and SRC kinase activity are necessary for this function. SRC is recruited to activated integrins by PTK2B/PYK2, thereby phosphorylating CBL, which in turn induces the activation and recruitment of phosphatidylinositol 3-kinase to the cell membrane in a signaling pathway that is critical for osteoclast function. SRC promotes energy production in osteoclasts by activating mitochondrial cytochrome C oxidase.

SRC phosphorylates DDR2 on tyrosine residues, thereby promoting its subsequent autophosphorylation. SRC phosphorylates RUNX3 and COX2 on tyrosine residues, TNK2 on Tyr-284 and CBL on Tyr-731. SRC enhances DDX58/RIG-I-elicited antiviral signaling. SRC phosphorylates PDPK1 at Tyr-9, Tyr-373 and Tyr-376. SRC phosphorylates BCAR1 at Tyr-128. SRC phosphorylates CBLC at multiple tyrosine residues, phosphorylation at Tyr-341 activates CBLC E3 activity. SRC is required for podosome formation. Inhibitors of SRC include, but not limited to, Dasatinib, bosutinib, ponatinib, Nintedanib, and Bevacizumab. Nucleic acid and polypeptide sequences of SRC are well-known and included, but not limited to, human SRC (NM_005417.4, NM_198291.2, NP_005408.1, NP_938033.1), monkey SRC (NM_001261334.1, NP_001248263.1), mouse SRC (NM_009271.3, NM_001025395.2, NP_001020566.1, NP_033297.2), and rat SRC (NM_031977.1, NP_114183.1).

ZNF658B (Zinc Finger Protein 658B (Pseudogene)) is a Pseudogene and may be involved in transcriptional regulation. Nucleic acid and polypeptide sequences of ZNF658B are well-known and include, but not limited to, human ZNF658B (NR_003528.3), monkey ZNF658B (NR_003528.3), mouse ZNF658B (NR_003528.3), and rat ZNF658B (NR_003528.3).

EGFR is a transmembrane glycoprotein that is a member of the protein kinase superfamily EGFR is a receptor tyrosine kinase of the ErbB family Four members of the ErbB family have been identified; EGFR (ErbB1, HER1), ErbB2 (HER2), ErbB3 (HER3) and ErbB4 (HER4). EGFR signaling drives many cellular responses. This protein is a receptor for members of the epidermal growth factor family EGFR is a cell surface protein that binds to epidermal growth factor. Binding of the protein to a ligand induces receptor dimerization and tyrosine autophosphorylation and leads to cell proliferation. Mutations in this gene are associated with lung cancer. Multiple alternatively spliced transcript variants that encode different protein isoforms have been found for this gene. EGFR is a receptor tyrosine kinase that binds ligands of the EGF family, and activates several signaling cascades to convert extracellular cues into appropriate cellular responses. Known ligands of EGFR include EGF, TGFA/TGF-alpha, amphiregulin, epigen/EPGN, BTC/betacellulin, epiregulin/EREG, and HBEGF/heparin-binding EGF. Ligand binding triggers receptor homo- and/or heterodimerization and autophosphorylation on key cytoplasmic residues. The phosphorylated receptor recruits adapter proteins like GRB2 which in turn activates complex downstream signaling cascades. EGFR activates at least 4 major downstream signaling cascades including the RAS-RAF-MEK-ERK, PI3 kinase-AKT, PLCgamma-PKC and STATs modules. EGFR may also activate the NF-kappa-B signaling cascade. EGFR also directly phosphorylates other proteins like RGS16, activating its GTPase activity and probably coupling the EGF receptor signaling to the G protein-coupled receptor signaling. EGFR also phosphorylates MUC1 and increases its interaction with SRC and CTNNB1/beta-catenin. Isoform 2 may act as an antagonist of EGF action. Inhibitors of EGFR include, but not limited to, Lapatinib, Gefitinib, Cetuximab, Panitumumab, and Erlotinib. Nucleic acid and polypeptide sequences of EGFR are well-known and include, but not limited to, human EGFR (NM_201282.1, NM_201283.1, NM_201284.1, NM_005228.3, NP_005219.2, NP_958439.1, NP_958440.1, NP_958441.1), monkey EGFR (XM_015133436.1, XP_014988922.1), mouse EGFR (NM_207655.2, NM_007912.4), and rat EGFR (NM_031507.1, NP_113695.1).

ARTN is a member of the glial cell line-derived neurotophic factor (GDNF) family of ligands which are a group of ligands within the TGF-beta superfamily of signaling molecules. GDNFs are unique in having neurotrophic properties and have potential use for gene therapy in neurodegenerative disease. Artemin has been shown in culture to support the survival of a number of peripheral neuron populations and at least one population of dopaminergic CNS neurons. Its role in the PNS and CNS is further substantiated by its expression pattern in the proximity of these neurons. Multiple transcript variants encoding different isoforms have been found for this gene. ARTN is a ligand for the RET receptor and uses GFR-alpha 3 as a coreceptor. ARTN is a ligand for the GFR-alpha-3-RET receptor complex but can also activate the GFR-alpha-1-RET receptor complex. ARTN supports the survival of sensory and sympathetic peripheral neurons in culture and also supports the survival of dopaminergic neurons of the ventral mid-brain. ARTN is a strong attractant of gut hematopoietic cells thus promoting the formation Peyers patch-like structures, a major component of the gut-associated lymphoid tissue. Nucleic acid and polypeptide sequences of ARTN are well-known and include, but not limited to, human ARTN (NM_057090.2, NM_057091.2, NM_001136215.1, NP_476431.2, NP_476432.2, NP_001129687.1), monkey ARTN (XM_015137660.1, XP_014993146.1), mouse ARTN (NM_001284193.1, NM_001284191.1, NM_001284192.1, NM_009711.4, NP_033841.1, NP_001271122.1, NP_001271120.1, NP_001271121.1), and rat ARTN (NM_053397.1, NP_445849.1).

SLC4A4 is a sodium bicarbonate cotransporter (NBC) involved in the regulation of bicarbonate secretion and absorption and intracellular pH. Mutations in this gene are associated with proximal renal tubular acidosis. Multiple transcript variants encoding different isoforms have been found for this gene. SLC4A4 may regulate bicarbonate influx/efflux at the basolateral membrane of cells and regulate intracellular pH. Isoform 2 may have a higher activity than isoform 1. Nucleic acid and polypeptide sequences of SLC4A4 are well-known and include, but not limited to, human SLC4A4 (NM_001098484.2, NM_003759.3, NM_001134742.1, NP_003750.1, NP_001091954.1, NP_001128214.1), monkey SLC4A4 (XM_012464422.1, XP_012319845.1), mouse SLC4A4 (NM_018760.2, NM_001136260.1, NM_001197147.1, NP_061230.2, NP_001129732.1, NP_001184076.1), and rat SLC4A4 (NM_053424.1, NP_445876.1).

mTOR belongs to a family of phosphatidylinositol kinase-related kinases. These kinases mediate cellular responses to stresses such as DNA damage and nutrient deprivation. This protein acts as the target for the cell-cycle arrest and immunosuppressive effects of the FKBP12-rapamycin complex. The ANGPTL7 gene is located in an intron of this gene. mTOR is a serine/threonine protein kinase which is a central regulator of cellular metabolism, growth and survival in response to hormones, growth factors, nutrients, energy and stress signals. MTOR directly or indirectly regulates the phosphorylation of at least 800 proteins. Functions as part of 2 structurally and functionally distinct signaling complexes mTORC1 and mTORC2 (mTOR complex 1 and 2). Activated mTORC1 up-regulates protein synthesis by phosphorylating key regulators of mRNA translation and ribosome synthesis. This includes phosphorylation of EIF4EBP1 and release of its inhibition toward the elongation initiation factor 4E (eiF4E). Moreover, phosphorylates and activates RPS6KB1 and RPS6KB2 that promote protein synthesis by modulating the activity of their downstream targets including ribosomal protein S6, eukaryotic translation initiation factor EIF4B, and the inhibitor of translation initiation PDCD4. Stimulates the pyrimidine biosynthesis pathway, both by acute regulation through RPS6KB1-mediated phosphorylation of the biosynthetic enzyme CAD, and delayed regulation, through transcriptional enhancement of the pentose phosphate pathway which produces 5-phosphoribosyl-1-pyrophosphate (PRPP), an allosteric activator of CAD at a later step in synthesis, this function is dependent on the mTORC1 complex. mTOR regulates ribosome synthesis by activating RNA polymerase III-dependent transcription through phosphorylation and inhibition of MAF1 an RNA polymerase III-repressor. In parallel to protein synthesis, also regulates lipid synthesis through SREBF1/SREBP1 and LPIN1. To maintain energy homeostasis, mTORC1 may also regulate mitochondrial biogenesis through regulation of PPARGC1A. mTORC1 also negatively regulates autophagy through phosphorylation of ULK1. Under nutrient sufficiency, phosphorylates ULK1 at Ser-758, disrupting the interaction with AMPK and preventing activation of ULK1. mTOR also prevents autophagy through phosphorylation of the autophagy inhibitor DAP. mTORC1 exerts a feedback control on upstream growth factor signaling that includes phosphorylation and activation of GRB10 a INSR-dependent signaling suppressor. Among other potential targets mTORC1 may phosphorylate CLIP1 and regulate microtubules. As part of the mTORC2 complex MTOR may regulate other cellular processes including survival and organization of the cytoskeleton. Plays a critical role in the phosphorylation at Ser-473 of AKT1, a pro-survival effector of phosphoinositide 3-kinase, facilitating its activation by PDK1. mTORC2 may regulate the actin cytoskeleton, through phosphorylation of PRKCA, PXN and activation of the Rho-type guanine nucleotide exchange factors RHOA and RAC1A or RAC1B. mTORC2 also regulates the phosphorylation of SGK1 at Ser-422. mTOR regulates osteoclastogensis by adjusting the expression of CEBPB isoforms (By similarity). Inhibitors of mTOR include, but not limited to, Everolimus, Temsirolimus, Miconazole, Sirolimus, and Pimecrolimus. Nucleic acid and polypeptide sequences of MTOR are well-known and include, but not limited to, human MTOR (NM_004958.3, NP_004949.1), monkey MTOR (XM_009192311.1, XP_009190575.1), mouse MTOR (NM_020009.2, NP_064393.2), and rat MTOR (NM_019906.1, NP_063971.1).

ACTB encodes one of six different actin proteins. Actins are highly conserved proteins that are involved in cell motility, structure, and integrity. This actin is a major constituent of the contractile apparatus and one of the two nonmuscle cytoskeletal actins. Inhibitors of ACTB include, but not limited to, Latrunculin A. Nucleic acid and polypeptide sequences of ACTB are well-known and include, but not limited to, human ACTB (NM_001101.3, NP_001092.1), monkey ACTB (NM_001033084.1, NP_001028256.1), mouse ACTB (NM_007393.5, NP_031419.1), and rat ACTB (NM_031144.3, NP_112406.1).

RUFY1 encodes a protein that contains a RUN domain and a FYVE-type zinc finger domain. The encoded protein binds to phosphatidylinositol-3-phosphate (PI3P) and plays a role in early endosomal trafficking, tethering and fusion through interactions with small GTPases including Rab4, Rab5 and Rab14. Alternatively spliced transcript variants encoding multiple isoforms have been observed for this gene. RUFY1 binds phospholipid vesicles containing phosphatidylinositol 3-phosphate and participates in early endosomal trafficking. Inhibitors of RUFY1 include, but not limited to, Guanosine triphosphate. Nucleic acid and polypeptide sequences of RUFY1 are well-known and include, but not limited to, human RUFY1 (NM_001040451.2, NM_025158.4, NM_001040452.2, NP_001035542.1, NP_001035541.1, NP_079434.3), monkey RUFY1 (XM_015141621.1, XP_014997107.1), mouse RUFY1 (NM_172557.2, NP_766145.1), and rat RUFY1 (NP_766145.1, NP_001094197.1).

PRKCA is a member of a family of serine- and threonine-specific protein kinases that can be activated by calcium and the second messenger diacylglycerol. PKC family members phosphorylate a wide variety of protein targets and are known to be involved in diverse cellular signaling pathways. PKC family members also serve as major receptors for phorbol esters, a class of tumor promoters. Each member of the PKC family has a specific expression profile and is believed to play a distinct role in cells. The protein encoded by this gene is one of the PKC family members. This kinase has been reported to play roles in many different cellular processes, such as cell adhesion, cell transformation, cell cycle checkpoint, and cell volume control. Knockout studies in mice suggest that this kinase may be a fundamental regulator of cardiac contractility and Ca(2+) handling in myocytes. Calcium-activated, phospholipid- and diacylglycerol (DAG)-dependent serine/threonine-protein kinase that is involved in positive and negative regulation of cell proliferation, apoptosis, differentiation, migration and adhesion, tumorigenesis, cardiac hypertrophy, angiogenesis, platelet function and inflammation, by directly phosphorylating targets such as RAF1, BCL2, CSPG4, TNNT2/CTNT, or activating signaling cascade involving MAPK1/3 (ERK1/2) and RAP1GAP. PRKCA is involved in cell proliferation and cell growth arrest by positive and negative regulation of the cell cycle. PRKCA can promote cell growth by phosphorylating and activating RAF1, which mediates the activation of the MAPK/ERK signaling cascade, and/or by up-regulating CDKN1A, which facilitates active cyclin-dependent kinase (CDK) complex formation in glioma cells. In intestinal cells stimulated by the phorbol ester PMA, PRKCA can trigger a cell cycle arrest program which is associated with the accumulation of the hyper-phosphorylated growth-suppressive form of RB1 and induction of the CDK inhibitors CDKN1A and CDKN1B. PRKCA exhibits anti-apoptotic function in glioma cells and protects them from apoptosis by suppressing the p53/TP53-mediated activation of IGFBP3, and in leukemia cells mediates anti-apoptotic action by phosphorylating BCL2. During macrophage differentiation induced by macrophage colony-stimulating factor (CSF1), is translocated to the nucleus and is associated with macrophage development. After wounding, PRKCA translocates from focal contacts to lamellipodia and participates in the modulation of desmosomal adhesion. PRKCA plays a role in cell motility by phosphorylating CSPG4, which induces association of CSPG4 with extensive lamellipodia at the cell periphery and polarization of the cell accompanied by increases in cell motility. Is highly expressed in a number of cancer cells where it can act as a tumor promoter and is implicated in malignant phenotypes of several tumors such as gliomas and breast cancers. PRKCA negatively regulates myocardial contractility and positively regulates angiogenesis, platelet aggregation and thrombus formation in arteries. PRKCA mediates hypertrophic growth of neonatal cardiomyocytes, in part through a MAPK1/3 (ERK1/2)-dependent signaling pathway, and upon PMA treatment, is required to induce cardiomyocyte hypertrophy up to heart failure and death, by increasing protein synthesis, protein-DNA ratio and cell surface area. PRKCA regulates cardiomyocyte function by phosphorylating cardiac troponin T (TNNT2/CTNT), which induces significant reduction in actomyosin ATPase activity, myofilament calcium sensitivity and myocardial contractility. In angiogenesis, PRKCA is required for full endothelial cell migration, adhesion to vitronectin (VTN), and vascular endothelial growth factor A (VEGFA)-dependent regulation of kinase activation and vascular tube formation. PRKCA is involved in the stabilization of VEGFA mRNA at post-transcriptional level and mediates VEGFA-induced cell proliferation. In the regulation of calcium-induced platelet aggregation, PRKCA mediates signals from the CD36/GP4 receptor for granule release, and activates the integrin heterodimer ITGA2B-ITGB3 through the RAP1GAP pathway for adhesion. During response to lipopolysaccharides (LPS), PRKCA may regulate selective LPS-induced macrophage functions involved in host defense and inflammation. But in some inflammatory responses, PRKCA may negatively regulate NF-kappa-B-induced genes, through IL1A-dependent induction of NF-kappa-B inhibitor alpha (NFKBIA/IKBA). Upon stimulation with 12-O-tetradecanoylphorbol-13-acetate (TPA), PRKCA phosphorylates EIF4G1, which modulates EIF4G1 binding to MKNK1 and may be involved in the regulation of EIF4E phosphorylation. PRKCA phosphorylates KIT, leading to inhibition of KIT activity. PRKCA phosphorylates ATF2 which promotes cooperation between ATF2 and JUN, activating transcription. Inhibitors for PRKCA include, but not limited to, Hydrochlorothiazide, and Tamoxifen. Nucleic acid and polypeptide sequences of PRKCA are well-known and include, but not limited to, human PRKCA (NM_002737.2, NP_002728.1), monkey PRKCA (NM_001260733.1, NP_001247662.1), mouse PRKCA (NM_011101.3, NP_035231.2), and rat PRKCA (NM_001105713.1, NP_001099183.1).

MAPK3 is a member of the MAP kinase family MAP kinases, also known as extracellular signal-regulated kinases (ERKs), act in a signaling cascade that regulates various cellular processes such as proliferation, differentiation, and cell cycle progression in response to a variety of extracellular signals. This kinase is activated by upstream kinases, resulting in its translocation to the nucleus where it phosphorylates nuclear targets. Alternatively spliced transcript variants encoding different protein isoforms have been described. MAPK3 is a serine/threonine kinase which acts as an essential component of the MAP kinase signal transduction pathway. MAPK1/ERK2 and MAPK3/ERK1 are the 2 MAPKs which play an important role in the MAPK/ERK cascade. They participate also in a signaling cascade initiated by activated KIT and KITLG/SCF. Depending on the cellular context, the MAPK/ERK cascade mediates diverse biological functions such as cell growth, adhesion, survival and differentiation through the regulation of transcription, translation, cytoskeletal rearrangements. The MAPK/ERK cascade plays also a role in initiation and regulation of meiosis, mitosis, and postmitotic functions in differentiated cells by phosphorylating a number of transcription factors. About 160 substrates have already been discovered for ERKs. Many of these substrates are localized in the nucleus, and seem to participate in the regulation of transcription upon stimulation. However, other substrates are found in the cytosol as well as in other cellular organelles, and those are responsible for processes such as translation, mitosis and apoptosis. Moreover, the MAPK/ERK cascade is also involved in the regulation of the endosomal dynamics, including lysosome processing and endosome cycling through the perinuclear recycling compartment (PNRC); as well as in the fragmentation of the Golgi apparatus during mitosis. The substrates include transcription factors (such as ATF2, BCL6, ELK1, ERF, FOS, HSF4 or SPZ1), cytoskeletal elements (such as CANX, CTTN, GJA1, MAP2, MAPT, PXN, SORBS3 or STMN1), regulators of apoptosis (such as BAD, BTG2, CASP9, DAPK1, IER3, MCL1 or PPARG), regulators of translation (such as EIF4EBP1) and a variety of other signaling-related molecules (like ARHGEF2, FRS2 or GRB10). Protein kinases (such as RAF1, RPS6KA1/RSK1, RPS6KA3/RSK2, RPS6KA2/RSK3, RPS6KA6/RSK4, SYK, MKNK1/MNK1, MKNK2/MNK2, RPS6KA5/MSK1, RPS6KA4/MSK2, MAPKAPK3 or MAPKAPK5) and phosphatases (such as DUSP1, DUSP4, DUSP6 or DUSP16) are other substrates which enable the propagation the MAPK/ERK signal to additional cytosolic and nuclear targets, thereby extending the specificity of the cascade. Inhibitors of MAPK include, but not limited to, Sumatriptan, Simvastatin, Trisenox, Sulindac, and Arsenic trioxide. Nucleic acid and polypeptide sequences of MAPK3 are well-known and include, but not limited to, human MAPK3 (NM_002746.2, NM_001109891.1, NM_001040056.2, NP_001035145.1, NP_002737.2, NP_001103361.1), monkey MAPK3 (XM_015125898.1, XP_014981384.1), mouse MAPK3 (NM_011952.2, NP_036082.1), and rat MAPK3 (NM_017347.2, NP_059043.1).

AKT1 is a serine-threonine protein kinase encoded by the AKT1 gene is catalytically inactive in serum-starved primary and immortalized fibroblasts. AKT1 and the related AKT2 are activated by platelet-derived growth factor. The activation is rapid and specific, and it is abrogated by mutations in the pleckstrin homology domain of AKT1. It was shown that the activation occurs through phosphatidylinositol 3-kinase. In the developing nervous system, AKT is a critical mediator of growth factor-induced neuronal survival. Survival factors can suppress apoptosis in a transcription-independent manner by activating the serine/threonine kinase AKT1, which then phosphorylates and inactivates components of the apoptotic machinery. Mutations in this gene have been associated with the Proteus syndrome. Multiple alternatively spliced transcript variants have been found for this gene. AKT1 is one of 3 closely related serine/threonine-protein kinases (AKT1, AKT2 and AKT3) called the AKT kinase, and which regulate many processes including metabolism, proliferation, cell survival, growth and angiogenesis. This is mediated through serine and/or threonine phosphorylation of a range of downstream substrates. Over 100 substrate candidates have been reported so far, but for most of them, no isoform specificity has been reported. AKT is responsible of the regulation of glucose uptake by mediating insulin-induced translocation of the SLC2A4/GLUT4 glucose transporter to the cell surface. Phosphorylation of PTPN1 at Ser-50 negatively modulates its phosphatase activity preventing dephosphorylation of the insulin receptor and the attenuation of insulin signaling. Phosphorylation of TBC1D4 triggers the binding of this effector to inhibitory 14-3-3 proteins, which is required for insulin-stimulated glucose transport. AKT regulates also the storage of glucose in the form of glycogen by phosphorylating GSK3A at Ser-21 and GSK3B at Ser-9, resulting in inhibition of its kinase activity. Phosphorylation of GSK3 isoforms by AKT is also thought to be one mechanism by which cell proliferation is driven. AKT regulates also cell survival via the phosphorylation of MAP3K5 (apoptosis signal-related kinase). Phosphorylation of Ser-83 decreases MAP3K5 kinase activity stimulated by oxidative stress and thereby prevents apoptosis. AKT mediates insulin-stimulated protein synthesis by phosphorylating TSC2 at Ser-939 and Thr-1462, thereby activating mTORC1 signaling and leading to both phosphorylation of 4E-BP1 and in activation of RPS6KB1. AKT is involved in the phosphorylation of members of the FOXO factors (Forkhead family of transcription factors), leading to binding of 14-3-3 proteins and cytoplasmic localization. In particular, FOXO1 is phosphorylated at Thr-24, Ser-256 and Ser-319. FOXO3 and FOXO4 are phosphorylated on equivalent sites. AKT has an important role in the regulation of NF-kappa-B-dependent gene transcription and positively regulates the activity of CREB1 (cyclic AMP (cAMP)-response element binding protein). The phosphorylation of CREB1 induces the binding of accessory proteins that are necessary for the transcription of pro-survival genes such as BCL2 and MCL1. AKT phosphorylates Ser-454 on ATP citrate lyase (ACLY), thereby potentially regulating ACLY activity and fatty acid synthesis. AKT activates the 3B isoform of cyclic nucleotide phosphodiesterase (PDE3B) via phosphorylation of Ser-273, resulting in reduced cyclic AMP levels and inhibition of lipolysis. AKT phosphorylates PIKFYVE on Ser-318, which results in increased PI(3)P-5 activity. The Rho GTPase-activating protein DLC1 is another substrate and its phosphorylation is implicated in the regulation cell proliferation and cell growth. AKT plays a role as key modulator of the AKT-mTOR signaling pathway controlling the tempo of the process of newborn neurons integration during adult neurogenesis, including correct neuron positioning, dendritic development and synapse formation. AKT signals downstream of phosphatidylinositol 3-kinase (PI(3)K) to mediate the effects of various growth factors such as platelet-derived growth factor (PDGF), epidermal growth factor (EGF), insulin and insulin-like growth factor I (IGF-I). AKT mediates the antiapoptotic effects of IGF-I. AKT is essential for the SPATA13-mediated regulation of cell migration and adhesion assembly and disassembly. AKT may be involved in the regulation of the placental development. Phosphorylates STK4/MST1 at Thr-120 and Thr-387 leading to inhibition of its: kinase activity, nuclear translocation, autophosphorylation and ability to phosphorylate FOXO3. AKT phosphorylates STK3/MST2 at Thr-117 and Thr-384 leading to inhibition of its: cleavage, kinase activity, autophosphorylation at Thr-180, binding to RASSF1 and nuclear translocation. AKT phosphorylates SRPK2 and enhances its kinase activity towards SRSF2 and ACIN1 and promotes its nuclear translocation. AKT phosphorylates RAF1 at Ser-259 and negatively regulates its activity. AKT phosphorylation of BAD stimulates its pro-apoptotic activity. AKT phosphorylates KAT6A at Thr-369 and this phosphorylation inhibits the interaction of KAT6A with PML and negatively regulates its acetylation activity towards p53/TP53.

AKT1-specific substrates have been recently identified, including palladin (PALLD), which phosphorylation modulates cytoskeletal organization and cell motility; prohibitin (PHB), playing an important role in cell metabolism and proliferation; and CDKN1A, for which phosphorylation at Thr-145 induces its release from CDK2 and cytoplasmic relocalization. These recent findings indicate that the AKT1 isoform has a more specific role in cell motility and proliferation. AKT1 phosphorylates CLK2 thereby controlling cell survival to ionizing radiation. Inhibitors for AKT1 include, but not limited to, Cisplatin, Everolimus, and Carboplatin. Nucleic acid and polypeptide sequences of AKT1 are well-known and include, but not limited to, human AKT1 (NM_005163.2, NM_001014431.1, NM_001014432.1, NP_005154.2, NP_001014431.1, NP_001014432.1), monkey AKT1 (NM_001261625.1, NP_001248554.1), mouse AKT1 (NM_009652.3, NM_001165894.1, NP_033782.1, NP_001159366.1), and rat AKT1 (NM_033230.2, NP_150233.1).

The term "SRC family kinase signaling pathway therapy" or SFKSP therapy encompass agents that modulate (e.g., enhance, reduce, inhibit, block, increase, decrease), directly or indirectly, the SRC family members. For instance, SRC family members (e.g., CSK) can be modulated directly or indirectly such as by overexpressing CSK or introducing an agent that enhances and/or increases the expression, activity, or level of CSK. Similarly, SRC family members (e.g., PAK2 and CRK) can be modulated directly or indirectly such as by using RNAi or any other means, or deletion of the gene (e.g., by knock-out or clustered regularly interspaced short palindromic repeats (CRISPR) technology) leads to inhibition of oncogenesis, tumor cell proliferation, tumor metastasis or induces tumor cell differentiation. A significantly modulated amount of SRC family member relative to the normal amount of the SRC family members is an amount less than or greater than, respectively, the standard error of the assay employed to assess amount, and preferably at least 5%, 10%, 15% 20%, 25%, 30%, 35%, 40%, 45%, 50%, 55%, 60%, 65%, 70%, 75%, 80%, 85%, 90%, 95%, 100%, 110%, 120%, 130%, 140%, 150%, 160%, 170%, 180%, 190%, 200%, 250%, 300%, 350%, 400%, 500%, 600%, 700%, 800%, 900%, 1000% or more than the normal (control) amount. Alternately, the amount of the biomarker (e.g., Tables 1 and 2) in the subject can be considered "significantly" modulated relative to the normal (control) amount if the amount is at least about 20%, 25%, 30%, 35%, 40%, 45%, 50%, 55%, 60%, 65%, 70%, 75%, 80%, 85%, 90%, 95%, 100%, 110%, 120%, 130%, 140%, 150%, 160%, 170%, 180%, 190%, 200%, 250%, 300%, 350%, 400%, 500%, 600%, 700%, 800%, 900%, 1000% or more, higher or lower, respectively, than the normal (control) amount of the SRC family member.

Exemplary agents useful for inhibiting members of the SFKSP, or other biomarkers described herein, include antibodies, small molecules, peptides, peptidomimetics, natural ligands, and derivatives of natural ligands, that can either bind and/or inactivate or inhibit target proteins, or fragments thereof; as well as RNA interference, antisense, nucleic acid aptamers, etc. that can downregulate the expression and/or activity of target nucleic acids, or fragments thereof. Exemplary inhibitors of the SFKSP signaling pathway are also well known in the art (see US20160175284) and include, but are not limited to: PAK2 inhibitors, such as FRAX597; SFK inhibitors, such as dastinib, saracatinib; CRK inhibitors, such as CAS 784211-09-2 (Calbiochem). Additional inhibitors include, but not limited to, abiraterone; abarelix; adriamycin; aactinomycin; acivicin; aclarubicin; acodazole hydrochloride; acronine; adozelesin; aldesleukin; alemtuzumab; allopurinol; alitretinoin; altretamine; ambomycin; ametantrone acetate; aminoglutethimide; aminolevulinic acid; amifostine; amsacrine; anastrozole; anthramycin; aprepitant; arsenic trioxide; asparaginase; asperlin; azacitidine; AZD6244; azetepa; azotomycin; batimastat; bendamustine hydrochloride; benzodepa; bevacizumab; bexarotene; bicalutamide; bisantrene hydrochloride; bisnafide dimesylate; bizelesin; bleomycin; bleomycin sulfate; bortezomib; bosutinib; brequinar sodium; bropirimine; busulfan; cabozantinib; cactinomycin; calusterone; caracemide; carbetimer; carboplatin; carmustine; carubicin hydrochloride; carzelesin; capecitabine; cedefingol; cetuximab; chlorambucil; cirolemycin; cisplatin; cladribine; clofarabine; crisnatol mesylate; cyclophosphamide; cytarabine;

dacarbazine; dasatinib; daunorubicin hydrochloride; dactinomycin; darbepoetin alfa; decitabine; degarelix; denileukin diftitox; dinaciclib; dexormaplatin; dexrazoxane hydrochloride; dezaguanine; dezaguanine mesylate; diaziquone; docetaxel; doxorubicin; doxorubicin hydrochloride; droloxifene; droloxifene citrate; dromostanolone propionate; duazomycin; edatrexate; eflornithine hydrochloride; elsamitrucin; eltrombopag olamine; enloplatin; ENMD-2076; enpromate; epipropidine; epirubicin hydrochloride; epoetin alfa; erbulozole; erlotinib hydrochloride; esorubicin hydrochloride; estramustine; estramustine phosphate sodium; etanidazole; etoposide; etoposide phosphate; etoprine; everolimus; exemestane; fadrozole hydrochloride; fazarabine; fenretinide; filgrastim; floxuridine; fludarabine phosphate; fluorouracil; flurocitabine; foretinib; fosquidone; fostriecin sodium; FRAX597, fulvestrant; gefitinib; gemcitabine; gemcitabine hydrochloride; gemcitabine-cisplatin; gemtuzumab ozogamicin; goserelin acetate; GSK1120212; histrelin acetate; hydroxyurea; idarubicin hydrochloride; ifosfamide; iimofosine; ibritumomab tiuxetan; idarubicin; ifosfamide; imatinib mesylate; imiquimod; interleukin II (including recombinant interleukin II, or rIL2), interferon alfa-2a; interferon alfa-2b; interferon alfa-nl; interferon alfa-n3; interferon beta-1 a; interferon gamma-1 b; iproplatin; irinotecan hydrochloride; ixabepilone; lanreotide acetate; lapatinib; lenalidomide; letrozole; leuprolide acetate; leucovorin calcium; leuprolide acetate; levamisole; liposomal cytarabine; liarozole hydrochloride; lometrexol sodium; lomustine; losoxantrone hydrochloride; masoprocol; maytansine; mechlorethamine hydrochloride; megestrol acetate; melengestrol acetate; melphalan; menogaril; mercaptopurine; methotrexate; methotrexate sodium; methoxsalen; metoprine; meturedepa; mitindomide; mitocarcin; mitocromin; mitogillin; mitomalcin; mitomycin C; mitosper; mitotane; mitoxantrone hydrochloride; MM-121; mycophenolic acid; nandrolone phenpropionate; nelarabine; nilotinib; nocodazoie; nofetumomab; nogalamycin; ofatumumab; onartuzumab; oprelvekin; ormaplatin; oxaliplatin; oxisuran; paclitaxel; palbociclib (PD-0332991); palifermin; palonosetron hydrochloride; pamidronate; pegfilgrastim; pemetrexed disodium; pentostatin; panitumumab; pazopanib hydrochloride; pemetrexed disodium; plerixafor; pralatrexate; pegaspargase; peliomycin; pentamustine; peplomycin sulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; quinacrine; raloxifene hydrochloride; rasburicase; recombinant HPV bivalent vaccine; recombinant HPV quadrivalent vaccine; riboprine; rogletimide; rituximab; romidepsin; romiplostim; safingol; safingol hydrochloride; saracatinib; sargramostim; seliciclib; semustine; simtrazene; sipuleucel-T; sorafenib; sparfosate sodium; sparsomycin; spirogermanium hydrochloride; spiromustine; spiroplatin; streptonigrin; streptozocin; sulofenur; sunitinib malate; talisomycin; tamoxifen citrate; tecogalan sodium; TAK-733; tegafur; teloxantrone hydrochloride; temozolomide; temoporfin; temsirolimus; teniposide; teroxirone; testolactone; thalidomide; thiamiprine; thioguanine; thiotepa; tiazofurin; tirapazamine; topotecan hydrochloride; toremifene; tositumomab and I 131 Iodine tositumomab; trastuzumab; trestolone acetate; tretinoin; triciribine phosphate; trimetrexate; trimetrexate glucuronate; triptorelin; tubulozole hydrochloride; U3-1287; uracil mustard; uredepa; valrubicin; vapreotide; verteporfin; vinblastine; vinblastine sulfate; vincristine sulfate; vindesine; vindesine sulfate; vinepidine sulfate; vinglycinate sulfate; vinleurosine sulfate; vinorelbine tartrate; vinrosidine sulfate; vinzolidine sulfate; vorinostat; vorozole; zeniplatin; zinostatin; zoledronic acid; or zorubicin hydrochloride.

In some embodiments, the at least one agent comprises an antisense oligonucleotide complementary to PAK2 and/or CRK. In still another embodiment, the at least one agent comprises a peptide or peptidomimetic that inhibits or blocks PAK2 and/or CRK. In yet another embodiment, the at least one agent comprises an aptamer that inhibits or blocks PAK2 and/or CRK. In another embodiment, the at least one agent is an antibody and/or an intrabody, or an antigen binding fragment thereof, which specifically binds to PAK2 and/or CRK (e.g., the antibody and/or intrabody, or antigen binding fragment thereof, is murine, chimeric, humanized, composite, or human). In still another embodiment, the antibody and/or intrabody, or antigen binding fragment thereof, is detectably labeled, comprises an effector domain, comprises an Fc domain, and/or is selected from the group consisting of Fv, Fav, F(ab')2), Fab', dsFv, scFv, sc(Fv)2, and diabodies fragments. In yet another embodiment, the antibody and/or intrabody, or antigen binding fragment thereof, is conjugated to a cytotoxic agent (e.g., the cytotoxic agent is selected from the group consisting of a chemotherapeutic agent, a biologic agent, a toxin, and a radioactive isotope).

The term "synergistic effect" refers to the combined effect of two or more anti-cancer agents (e.g., two or more Src family kinase signaling pathway inhibitors, combination of aromatase inhibitor and at least one Src family kinase signaling pathway inhibitor, or anti-estrogen and at least one Src family kinase signaling pathway inhibitor) can be greater than the sum of the separate effects of the anticancer agents alone. In some embodiments, an endocrine resistant breast cancer is significantly or synergistically more responsive when treated with two or more SFKSP inhibitors, such as a PAK2 inhibitor and CRK inhibitor in combination.

"Short interfering RNA" (siRNA), also referred to herein as "small interfering RNA" is defined as an agent which functions to inhibit expression of a target biomarker nucleic acid, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) *RNA* April; 9(4):493-501 incorporated by reference herein).

RNA interfering agents, e.g., siRNA molecules, may be administered to a patient having or at risk for having cancer, to inhibit expression of a biomarker gene which is overexpressed in cancer and thereby treat, prevent, or inhibit cancer in the subject.

The term "subject" refers to any healthy animal, mammal or human, or any animal, mammal or human afflicted with a breast cancer. The term "subject" is interchangeable with "patient."

The term "survival" includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g. time of diagnosis or start of treatment) and end point (e.g. death, recurrence or metastasis). In addition, criteria for efficacy of treatment can be expanded to include response to chemotherapy, probability of survival, probability of metastasis within a given time period, and probability of tumor recurrence.

The term "therapeutic effect" refers to a local or systemic effect in animals, particularly mammals, and more particularly humans, caused by a pharmacologically active substance. The term thus means any substance intended for use in the diagnosis, cure, mitigation, treatment or prevention of disease or in the enhancement of desirable physical or mental development and conditions in an animal or human. The phrase "therapeutically-effective amount" means that amount of such a substance that produces some desired local or systemic effect at a reasonable benefit/risk ratio applicable to any treatment. In certain embodiments, a therapeutically effective amount of a compound will depend on its therapeutic index, solubility, and the like. For example, certain compounds discovered by the methods of the present invention may be administered in a sufficient amount to produce a reasonable benefit/risk ratio applicable to such treatment.

The terms "therapeutically-effective amount" and "effective amount" as used herein means that amount of a compound, material, or composition comprising a compound of the present invention which is effective for producing some desired therapeutic effect in at least a sub-population of cells in an animal at a reasonable benefit/risk ratio applicable to any medical treatment. Toxicity and therapeutic efficacy of subject compounds may be determined by standard pharmaceutical procedures in cell cultures or experimental animals, e.g., for determining the $LD_{50}$ and the $ED_{50}$. Compositions that exhibit large therapeutic indices are preferred. In some embodiments, the $LD_{50}$ (lethal dosage) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more reduced for the agent relative to no administration of the agent. Similarly, the $ED_{50}$ (i.e., the concentration which achieves a half-maximal inhibition of symptoms) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. Also, Similarly, the $IC_{50}$ (i.e., the concentration which achieves half-maximal cytotoxic or cytostatic effect on cancer cells) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. In some embodiments, cancer cell growth in an assay can be inhibited by at least about 10%, 15%, 20%, 25%, 30%, 35%, 40%, 45%, 50%, 55%, 60%, 65%, 70%, 75%, 80%, 85%, 90%, 95%, or even 100%. In another embodiment, at least about a 10%, 15%, 20%, 25%, 30%, 35%, 40%, 45%, 50%, 55%, 60%, 65%, 70%, 75%, 80%, 85%, 90%, 95%, or even 100% decrease in a solid malignancy can be achieved.

In one embodiment, a therapeutically effective amount of antibody (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of an antibody can include a single treatment or, preferably, can include a series of treatments. In a preferred example, a subject is treated with antibody in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks. It will also be appreciated that the effective dosage of antibody used for treatment may increase or decrease over the course of a particular treatment. Changes in dosage may result from the results of diagnostic assays.

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a biomarker nucleic acid and normal post-transcriptional processing (e.g. splicing), if any, of the RNA transcript, and reverse transcription of the RNA transcript.

As used herein, the term "anergy" or "tolerance" includes refractivity to activating receptor-mediated stimulation. Such refractivity is generally antigen-specific and persists after exposure to the tolerizing antigen has ceased. For example, anergy in T cells (as opposed to unresponsiveness) is characterized by lack of cytokine production, e.g., IL-2. T cell anergy occurs when T cells are exposed to antigen and receive a first signal (a T cell receptor or CD-3 mediated signal) in the absence of a second signal (a costimulatory signal). Under these conditions, reexposure of the cells to the same antigen (even if reexposure occurs in the presence of a costimulatory polypeptide) results in failure to produce cytokines and, thus, failure to proliferate. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate IL-2 gene transcription induced by a heterologous promoter under the control of the 5' IL-2 gene enhancer or by a multimer of the AP1 sequence that can be found within the enhancer (Kang et al. (1992) Science 257:1134).

As used herein, the term "unresponsiveness" includes refractivity of cancer cells to therapy or refractivity of therapeutic cells, such as immune cells, to stimulation, e.g., stimulation via an activating receptor or a cytokine. Unresponsiveness can occur, e.g., because of exposure to immunosuppressants or exposure to high doses of antigen. As used herein, the term "anergy" or "tolerance" includes refractivity to activating receptor-mediated stimulation. Such refractivity is generally antigen-specific and persists after exposure to the tolerizing antigen has ceased. For example, anergy in T cells (as opposed to unresponsiveness) is characterized by lack of cytokine production, e.g., IL-2. T cell anergy occurs when T cells are exposed to antigen and receive a first signal (a T cell receptor or CD-3 mediated signal) in the absence of a second signal (a costimulatory signal). Under these conditions, reexposure of the cells to the same antigen (even if reexposure occurs in the presence of a costimulatory polypeptide) results in failure to produce cytokines and, thus, failure to proliferate. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate IL-2 gene transcription induced by a heterologous promoter under the control of the 5' IL-2 gene enhancer or by a multimer of the AP1 sequence that can be found within the enhancer (Kang et al. (1992) *Science* 257:1134).

There is a known and definite correspondence between the amino acid sequence of a particular protein and the nucleotide sequences that can code for the protein, as defined by the genetic code (shown below). Likewise, there is a known and definite correspondence between the nucleotide sequence of a particular nucleic acid and the amino acid sequence encoded by that nucleic acid, as defined by the genetic code.

| GENETIC CODE | |
|---|---|
| Alanine (Ala, A) | GCA, GCC, GCG, GCT |
| Arginine (Arg, R) | AGA, ACG, CGA, CGC, CGG, CGT |
| Asparagine (Asn, N) | AAC, AAT |
| Aspartic acid (Asp, D) | GAC, GAT |
| Cysteine (Cys, C) | TGC, TGT |
| Glutamic acid (Glu, E) | GAA, GAG |
| Glutamine (Gln, Q) | CAA, CAG |
| Glycine (Gly, G) | GGA, GGC, GGG, GGT |
| Histidine (His, H) | CAC, CAT |
| Isoleucine (Ile, I) | ATA, ATC, ATT |
| Leucine (Leu, L) | CTA, CTC, CTG, CTT, TTA, TTG |
| Lysine (Lys, K) | AAA, AAG |
| Methionine (Met, M) | ATG |
| Phenylalanine (Phe, F) | TTC, TTT |
| Proline (Pro, P) | CCA, CCC, CCG, CCT |
| Serine (Ser, S) | AGC, AGT, TCA, TCC, TCG, TCT |
| Threonine (Thr, T) | ACA, ACC, ACG, ACT |
| Tryptophan (Trp, W) | TGG |
| Tyrosine (Tyr, Y) | TAC, TAT |
| Valine (Val, V) | GTA, GTC, GTG, GTT |
| Termination signal (end) | TAA, TAG, TGA |

An important and well known feature of the genetic code is its redundancy, whereby, for most of the amino acids used to make proteins, more than one coding nucleotide triplet may be employed (illustrated above). Therefore, a number of different nucleotide sequences may code for a given amino acid sequence. Such nucleotide sequences are considered functionally equivalent since they result in the production of the same amino acid sequence in all organisms (although certain organisms may translate some sequences more efficiently than they do others). Moreover, occasionally, a methylated variant of a purine or pyrimidine may be found in a given nucleotide sequence. Such methylations do not affect the coding relationship between the trinucleotide codon and the corresponding amino acid.

In view of the foregoing, the nucleotide sequence of a DNA or RNA encoding a biomarker nucleic acid (or any portion thereof) can be used to derive the polypeptide amino acid sequence, using the genetic code to translate the DNA or RNA into an amino acid sequence. Likewise, for polypeptide amino acid sequence, corresponding nucleotide sequences that can encode the polypeptide can be deduced from the genetic code (which, because of its redundancy, will produce multiple nucleic acid sequences for any given amino acid sequence). Thus, description and/or disclosure herein of a nucleotide sequence which encodes a polypeptide should be considered to also include description and/or disclosure of the amino acid sequence encoded by the nucleotide sequence. Similarly, description and/or disclosure of a polypeptide amino acid sequence herein should be considered to also include description and/or disclosure of all possible nucleotide sequences that can encode the amino acid sequence.

Finally, nucleic acid and amino acid sequence information for the loci and biomarkers of the present invention (e.g., biomarkers listed in Tables 1 and 2) are well known in the art and readily available on publicly available databases, such as the National Center for Biotechnology Information (NCBI). For example, exemplary nucleic acid and amino acid sequences derived from publicly available sequence databases are provided below. It is to be noted that the terms described above can further be used to refer to any combination of features described herein regarding the biomarkers. For example, any combination of sequence composition, percentage identify, sequence length, domain structure, functional activity, etc. can be used to describe a biomarker of the present invention.

Human CSK nucleic acid (NM_004383) and amino acid (NP_001120662, NP_004374) sequences are publicly available on the GenBank database maintained by the U.S. National Center for Biotechnology Information. Nucleic acid and polypeptide sequences of CSK orthologs in species other than humans are also well known and include, for example, mouse CSK (NM_007783, NP_001291690), chimpanzee CSK (XM_016927198, XP_016782687), monkey CSK (NM_001261636, NP_001248565), dog CSK (XM_544774, XP_005638682), cow CSK (NM_001075397, NP_001068865), rat CSK (NM_001030039, NP_001025210), and chicken CSK (NM_205425, NP_990756).

Representative sequences of CSK orthologs are presented below in Table 1. CSK agents, including antibodies, nucleic acids, and the like are well-known in the art. It is to be noted that the term can further be used to refer to any combination of features described herein regarding CSK molecules. For example, any combination of sequence composition, percentage identify, sequence length, domain structure, functional activity, etc. can be used to describe an CSK molecule of the present invention.

TABLE 1

SEQ ID NO: 1 *Homo sapiens* c-src tyrosine kinase (CSK) cDNA,
transcript variant 1 (NM_004383)

```
atgtcagcaa tacaggccgc ctggccatcc ggtacagaat gtattgccaa gtacaacttc    60
cacggcactg ccgagcagga cctgcccttc tgcaaaggag acgtgctcac cattgtggcc   120
gtcaccaagg accccaactg gtacaaagcc aaaaacaagg tgggccgtga gggcatcatc   180
ccagccaact acgtccagaa gcgggagggc gtgaaggcgg gtaccaaact cagcctcatg   240
ccttggttcc acggcaagat cacacgggag caggctgagc ggcttctgta cccgccggag   300
acaggcctgt tcctggtgcg ggagagcacc aactaccccg gagactacac gctgtgcgtg   360
agctgcgacg gcaaggtgga gcactaccgc atcatgtacc atgccagcaa gctcagcatc   420
gacgaggagg tgtactttga aacctcatg cagctggtgg agcactacac ctcagacgca   480
gatggactct gtacgcgcct cattaaacca aaggtcatgg agggcacagt ggcggcccag   540
gatgagttct accgcagcgg ctgggccctg aacatgaagg agctgaagct gctgcagacc   600
atcgggaagg gggagttcgg agacgtgatg ctgggcgatt accgagggaa caaagtcgcc   660
gtcaagtgca ttaagaacga cgccactgcc caggccttcc tggctgaagc ctcagtcatg   720
acgcaactgc ggcatagcaa cctggtgcag ctcctgggcg tgatcgtgga ggagaagggc   780
gggctctaca tcgtcactga gtacatggcc aaggggagcc ttgtggacta cctgcggtct   840
aggggtcggt cagtgctggg cggagactgt ctcctcaagt tctcgctaga tgtctgcgag   900
gccatggaat acctggaggg caacaatttc gtgcatcgag acctggctgc ccgcaatgtg   960
ctggtgtctg aggacaacgt ggccaaggtc agcgactttg gtctcaccaa ggaggcgtcc  1020
agcacccagg acacgggcaa gctgccagtc aagtggacag cccctgaggc cctgagagag  1080
aagaaattct ccactaagtc tgacgtgtgg agtttcggaa tccttctctg ggaaatctac  1140
tcctttgggc gagtgcctta tccaagaatt cccctgaagg acgtcgtccc tcgggtggag  1200
aagggctaca agatggatgc ccccgacggc tgcccgcccg cagtctatga agtcatgaag  1260
aactgctggc acctggacgc cgccatgcgg ccctccttcc tacagctccg agagcagctt  1320
gagcacatca aaacccacga gctgcacctg tga                              1353
```

SEQ ID NO: 2 *Homo sapiens* c-src tyrosine kinase (CSK) cDNA,
transcript variant 2 (NM_001127190)

```
atgtcagcaa tacaggccgc ctggccatcc ggtacagaat gtattgccaa gtacaacttc    60
cacggcactg ccgagcagga cctgcccttc tgcaaaggag acgtgctcac cattgtggcc   120
gtcaccaagg accccaactg gtacaaagcc aaaaacaagg tgggccgtga gggcatcatc   180
ccagccaact acgtccagaa gcgggagggc gtgaaggcgg gtaccaaact cagcctcatg   240
ccttggttcc acggcaagat cacacgggag caggctgagc ggcttctgta cccgccggag   300
acaggcctgt tcctggtgcg ggagagcacc aactaccccg gagactacac gctgtgcgtg   360
agctgcgacg gcaaggtgga gcactaccgc atcatgtacc atgccagcaa gctcagcatc   420
gacgaggagg tgtactttga aacctcatg cagctggtgg agcactacac ctcagacgca   480
gatggactct gtacgcgcct cattaaacca aaggtcatgg agggcacagt ggcggcccag   540
gatgagttct accgcagcgg ctgggccctg aacatgaagg agctgaagct gctgcagacc   600
atcgggaagg gggagttcgg agacgtgatg ctgggcgatt accgagggaa caaagtcgcc   660
gtcaagtgca ttaagaacga cgccactgcc caggccttcc tggctgaagc ctcagtcatg   720
acgcaactgc ggcatagcaa cctggtgcag ctcctgggcg tgatcgtgga ggagaagggc   780
gggctctaca tcgtcactga gtacatggcc aaggggagcc ttgtggacta cctgcggtct   840
aggggtcggt cagtgctggg cggagactgt ctcctcaagt tctcgctaga tgtctgcgag   900
gccatggaat acctggaggg caacaatttc gtgcatcgag acctggctgc ccgcaatgtg   960
ctggtgtctg aggacaacgt ggccaaggtc agcgactttg gtctcaccaa ggaggcgtcc  1020
agcacccagg acacgggcaa gctgccagtc aagtggacag cccctgaggc cctgagagag  1080
aagaaattct ccactaagtc tgacgtgtgg agtttcggaa tccttctctg ggaaatctac  1140
tcctttgggc gagtgcctta tccaagaatt cccctgaagg acgtcgtccc tcgggtggag  1200
aagggctaca agatggatgc ccccgacggc tgcccgcccg cagtctatga agtcatgaag  1260
aactgctggc acctggacgc cgccatgcgg ccctccttcc tacagctccg agagcagctt  1320
gagcacatca aaacccacga gctgcacctg tga                              1353
```

SEQ ID NO: 3 *Homo sapiens* c-src tyrosine kinase (CSK) cDNA,
transcript variant X1 (XM_005254165)

```
atgtcagcaa tacaggccgc ctggccatcc ggtacagaat gtattgccaa gtacaacttc    60
cacggcactg ccgagcagga cctgcccttc tgcaaaggag acgtgctcac cattgtggcc   120
gtcaccaagg accccaactg gtacaaagcc aaaaacaagg tgggccgtga gggcatcatc   180
ccagccaact acgtccagaa gcgggagggc gtgaaggcgg gtaccaaact cagcctcatg   240
ccttggttcc acggcaagat cacacgggag caggctgagc ggcttctgta cccgccggag   300
acaggcctgt tcctggtgcg ggagagcacc aactaccccg gagactacac gctgtgcgtg   360
agctgcgacg gcaaggtgga gcactaccgc atcatgtacc atgccagcaa gctcagcatc   420
gacgaggagg tgtactttga aacctcatg cagctggtgg agcactacac ctcagacgca   480
gatggactct gtacgcgcct cattaaacca aaggtcatgg agggcacagt ggcggcccag   540
gatgagttct accgcagcgg ctgggccctg aacatgaagg agctgaagct gctgcagacc   600
atcgggaagg gggagttcgg agacgtgatg ctgggcgatt accgagggaa caaagtcgcc   660
gtcaagtgca ttaagaacga cgccactgcc caggccttcc tggctgaagc ctcagtcatg   720
acgcaactgc ggcatagcaa cctggtgcag ctcctgggcg tgatcgtgga ggagaagggc   780
gggctctaca tcgtcactga gtacatggcc aaggggagcc ttgtggacta cctgcggtct   840
aggggtcggt cagtgctggg cggagactgt ctcctcaagt tctcgctaga tgtctgcgag   900
gccatggaat acctggaggg caacaatttc gtgcatcgag acctggctgc ccgcaatgtg   960
ctggtgtctg aggacaacgt ggccaaggtc agcgactttg gtctcaccaa ggaggcgtcc  1020
agcacccagg acacgggcaa gctgccagtc aagtggacag cccctgaggc cctgagagag  1080
aagaaattct ccactaagtc tgacgtgtgg agtttcggaa tccttctctg ggaaatctac  1140
tcctttgggc gagtgcctta tccaagaatt cccctgaagg acgtcgtccc tcgggtggag  1200
aagggctaca agatggatgc ccccgacggc tgcccgcccg cagtctatga agtcatgaag  1260
aactgctggc acctggacgc cgccatgcgg ccctccttcc tacagctccg agagcagctt  1320
gagcacatca aaacccacga gctgcacctg tga                              1353
```

TABLE 1-continued

SEQ ID NO: 4 Homo sapiens c-src tyrosine kinase (CSK) cDNA,
transcript variant X2 (XM_017021925)

```
atgtcagcaa tacaggccgc ctggccatcc ggtacagaat gtattgccaa gtacaacttc      60
cacggcactg ccgagcagga cctgcccttc tgcaaaggag acgtgctcac cattgtggcc     120
gtcaccaagg accccaactg gtacaaagcc aaaaacaagg tgggccgtga gggcatcatc     180
ccagccaact acgtccagaa gcgggagggc gtgaaggcgg gtaccaaact cagcctcatg     240
ccttggttcc acggcaagat cacacgggag caggctgagc ggcttctgta cccgccggag     300
acaggcctgt tcctggtgcg ggagagcacc aactaccccg gagactacac gctgtgcgtg     360
agctgcgacg gcaaggtgga gcactaccgc atcatgtacc atgccagcaa gctcagcatc     420
gacgaggagg tgtactttga aacctcatg cagctggtgg agcactacac ctcagacgca     480
gatggactct gtacgcgcct cattaaacca aaggtcatgg agggcacagt ggcggcccag     540
gatgagttct accgcagcgg ctgggccctg aacatgaagg agctgaagct gctgcagacc     600
atcgggaagg gggagttcgg agacgtgatg ctgggcgatt accgagggaa caaagtcgcc     660
gtcaagtgca ttaagaacga cgccactgcc caggccttcc tggctgaagc ctcagtcatg     720
acgcaactgc ggcatagcaa cctggtgcag ctcctgggcg tgatcgtgga ggagaagggc     780
gggctctaca tcgtcactga gtacatggcc aaggggagcc ttgtggacta cctgcggtct     840
aggggtcggt cagtgctggg cggagactgt ctcctcaagt tctcgctaga tgtctgcgag     900
gccatggaat acctggaggg caacaatttc gtgcatcgag acctggctgc ccgcaatgtg     960
ctggtgtctg aggacaacgt ggccaaggtc agcgactttg gtctcaccaa ggaggcgtcc    1020
agcacccagg acacgggcaa gctgccagtc aagtggacag cccctgaggc cctgagagag    1080
aagaaattct ccactaagtc tgacgtgtgg agtttcggaa tccttctctg ggaaatctac    1140
tcctttgggc gagtgcctta tccaagaatt cccctgaagg acgtcgtccc tcgggtggag    1200
aagggctaca agatggatgc ccccgacggc tgcccgcccg cagtctatga agtcatgaag    1260
aactgctggc acctggacgc cgccatgcgg ccctccttcc tacagctccg agagcagctt    1320
gagcacatca aacccacga gctgcacctg tga                                   1353
```

SEQ ID NO: 5 Homo sapiens c-src tyrosine-protein kinase CSK
amino acid sequence, isoform X1 (XP_016877414)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCDGKVEHYR IMYHASKLSI DEEVYFENLM QLVEHYTSDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGDC LLKFSLDVCE      300
AMEYLEGNNF VHRDLAARNV LVSEDNVAKV SDFGLTKEAS STQDTGKLPV KWTAPEALRE     360
KKFSTKSDVW SFGILLWEIY SFGRVPYPRI PLKDVVPRVE KGYKMDAPDG CPPAVYEVMK     420
NCWHLDAAMR PSFLQLREQL EHIKTHELHL                                      450
```

SEQ ID NO: 6 Homo sapiens c-src tyrosine-protein kinase CSK
amino acid sequence, isoform X1 (XP_005254222)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCDGKVEHYR IMYHASKLSI DEEVYFENLM QLVEHYTSDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGDC LLKFSLDVCE      300
AMEYLEGNNF VHRDLAARNV LVSEDNVAKV SDFGLTKEAS STQDTGKLPV KWTAPEALRE     360
KKFSTKSDVW SFGILLWEIY SFGRVPYPRI PLKDVVPRVE KGYKMDAPDG CPPAVYEVMK     420
NCWHLDAAMR PSFLQLREQL EHIKTHELHL                                      450
```

SEQ ID NO: 7 Homo sapiens c-src tyrosine-protein kinase CSK
amino acid sequence (NP_001120662)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCDGKVEHYR IMYHASKLSI DEEVYFENLM QLVEHYTSDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGDC LLKFSLDVCE      300
AMEYLEGNNF VHRDLAARNV LVSEDNVAKV SDFGLTKEAS STQDTGKLPV KWTAPEALRE     360
KKFSTKSDVW SFGILLWEIY SFGRVPYPRI PLKDVVPRVE KGYKMDAPDG CPPAVYEVMK     420
NCWHLDAAMR PSFLQLREQL EHIKTHELHL                                      450
```

SEQ ID NO: 8 Homo sapiens c-src tyrosine-protein kinase CSK
amino acid sequence (NP_004374)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCDGKVEHYR IMYHASKLSI DEEVYFENLM QLVEHYTSDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGDC LLKFSLDVCE      300
AMEYLEGNNF VHRDLAARNV LVSEDNVAKV SDFGLTKEAS STQDTGKLPV KWTAPEALRE     360
KKFSTKSDVW SFGILLWEIY SFGRVPYPRI PLKDVVPRVE KGYKMDAPDG CPPAVYEVMK     420
NCWHLDAAMR PSFLQLREQL EHIKTHELHL                                      450
```

TABLE 1-continued

SEQ ID NO: 9 Mus musculus c-src tyrosine kinase (CSK) cDNA,
transcript variant 1 (NM_007783)

```
atgtcggcaa tacaggccgc ctggccatcc ggtacagaat gtattgccaa gtacaacttc    60
catggcactg ctgagcaaga ccttcccttc tgcaaaggag atgtgctcac catcgtggct   120
gtcaccaagg accccaactg gtacaaagcc aaaaacaaag tgggccgtga gggcatcatc   180
ccagccaact atgtccagaa gcgtgagggt gtgaaggcag gcaccaaact cagccttatg   240
ccctggttcc acggcaagat cacacgggag caggccgagc ggcttcttta cccaccagag   300
acaggcctgt tcctcgtgcg ggaaagcacc aactaccctg agactacac actgtgtgtg    360
agctgtgagg gcaaggtgga gcactaccgc atcatgtatc atgcgagcaa gctgagcatt   420
gatgaggagg tgtactttga gaacctcatg cagctggtgg agcactacac cacagatgcc   480
gatggactct gcactcgcct catcaaacca aaggtcatgg agggcaccgt ggcggcccag   540
gatgagttct accgcagtgg ctgggcactg aacatgaagg aactgaagct gctacagaca   600
ataggaagg gggagtttgg agatgtgatg ctggggatt accgggcaa caaagttgca      660
gtcaagtgca tcaagaatga cgcaactgcc caggccttcc tggctgaagc ctccgtcatg   720
acgcaacttc ggcacagcaa cctcgtccag ctgctgggtg tgattgtgga ggagaagggt   780
gggctctaca tcgtcacaga gtacatggcc aaggggagtt tggtggacta tcttcgatca   840
cgtggtcgtt cggtgctagg tggagactgt ctccctcaaat tctcattaga cgtctgtgaa   900
gccatggagt acctggaggg taacaattt gtgcaccggg acttggctgc ccggaatgtg    960
ctggtgtctg aagacaacgt ggccaaagtc agtgactttg gcctcactaa ggaagcctcc  1020
agcactcagg acacaggcaa gctgccagtc aaatggacag cgcctgaagc cttgagagag  1080
aagaaatttt ccaccaagtc tgatgtgtgg agtttcggaa tccttctctg ggaaatctat  1140
tccttcgggc gagtgcctta cccaagaatt ccctgaagg acgtcgtccc tcgggtggaa   1200
aagggctata agatggacgc tccggatggc tgcccgcccg cagtctacga ggtgatgaag  1260
aactgctggc acctggatgc tgccacacgg cccacgtttt tgcagcttcg ggaacagctc  1320
gagcacatca agacccatga gctgcacctg tga                                1353
```

SEQ ID NO: 10 Mus musculus c-src tyrosine kinase (CSK) cDNA,
transcript variant 2 (NM_001304761)

```
atgtcggcaa tacaggccgc ctggccatcc ggtacagaat gtattgccaa gtacaacttc    60
catggcactg ctgagcaaga ccttcccttc tgcaaaggag atgtgctcac catcgtggct   120
gtcaccaagg accccaactg gtacaaagcc aaaaacaaag tgggccgtga gggcatcatc   180
ccagccaact atgtccagaa gcgtgagggt gtgaaggcag gcaccaaact cagccttatg   240
ccctggttcc acggcaagat cacacgggag caggccgagc ggcttcttta cccaccagag   300
acaggcctgt tcctcgtgcg ggaaagcacc aactaccctg agactacac actgtgtgtg    360
agctgtgagg gcaaggtgga gcactaccgc atcatgtatc atgcgagcaa gctgagcatt   420
gatgaggagg tgtactttga gaacctcatg cagctggtgg agcactacac cacagatgcc   480
gatggactct gcactcgcct catcaaacca aaggtcatgg agggcaccgt ggcggcccag   540
gatgagttct accgcagtgg ctgggcactg aacatgaagg aactgaagct gctacagaca   600
ataggaagg gggagtttgg agatgtgatg ctggggatt accgggcaa caaagttgca      660
gtcaagtgca tcaagaatga cgcaactgcc caggccttcc tggctgaagc ctccgtcatg   720
acgcaacttc ggcacagcaa cctcgtccag ctgctgggtg tgattgtgga ggagaagggt   780
gggctctaca tcgtcacaga gtacatggcc aaggggagtt tggtggacta tcttcgatca   840
cgtggtcgtt cggtgctagg tggagactgt ctccctcaaat tctcattaga cgtctgtgaa   900
gccatggagt acctggaggg taacaattt gtgcaccggg acttggctgc ccggaatgtg    960
ctggtgtctg aagacaacgt ggccaaagtc agtgactttg gcctcactaa ggaagcctcc  1020
agcactcagg acacaggcaa gctgccagtc aaatggacag cgcctgaagc cttgagagag  1080
aagaaatttt ccaccaagtc tgatgtgtgg agtttcggaa tccttctctg ggaaatctat  1140
tccttcgggc gagtgcctta cccaagaatt ccctgaagg acgtcgtccc tcgggtggaa   1200
aagggctata agatggacgc tccggatggc tgcccgcccg cagtctacga ggtgatgaag  1260
aactgctggc acctggatgc tgccacacgg cccacgtttt tgcagcttcg ggaacagctc  1320
gagcacatca agacccatga gctgcacctg tga                                1353
```

SEQ ID NO: 11 Mus musculus c-src tyrosine kinase (CSK) cDNA,
transcript variant X1 (XM_006510802)

```
atgtcggcaa tacaggccgc ctggccatcc ggtacagaat gtattgccaa gtacaacttc    60
catggcactg ctgagcaaga ccttcccttc tgcaaaggag atgtgctcac catcgtggct   120
gtcaccaagg accccaactg gtacaaagcc aaaaacaaag tgggccgtga gggcatcatc   180
ccagccaact atgtccagaa gcgtgagggt gtgaaggcag gcaccaaact cagccttatg   240
ccctggttcc acggcaagat cacacgggag caggccgagc ggcttcttta cccaccagag   300
acaggcctgt tcctcgtgcg ggaaagcacc aactaccctg agactacac actgtgtgtg    360
agctgtgagg gcaaggtgga gcactaccgc atcatgtatc atgcgagcaa gctgagcatt   420
gatgaggagg tgtactttga gaacctcatg cagctggtgg agcactacac cacagatgcc   480
gatggactct gcactcgcct catcaaacca aaggtcatgg agggcaccgt ggcggcccag   540
gatgagttct accgcagtgg ctgggcactg aacatgaagg aactgaagct gctacagaca   600
ataggaagg gggagtttgg agatgtgatg ctggggatt accgggcaa caaagttgca      660
gtcaagtgca tcaagaatga cgcaactgcc caggccttcc tggctgaagc ctccgtcatg   720
acgcaacttc ggcacagcaa cctcgtccag ctgctgggtg tgattgtgga ggagaagggt   780
gggctctaca tcgtcacaga gtacatggcc aaggggagtt tggtggacta tcttcgatca   840
cgtggtcgtt cggtgctagg tggagactgt ctccctcaaat tctcattaga cgtctgtgaa   900
gccatggagt acctggaggg taacaattt gtgcaccggg acttggctgc ccggaatgtg    960
ctggtgtctg aagacaacgt ggccaaagtc agtgactttg gcctcactaa ggaagcctcc  1020
agcactcagg acacaggcaa gctgccagtc aaatggacag cgcctgaagc cttgagagag  1080
aagaaatttt ccaccaagtc tgatgtgtgg agtttcggaa tccttctctg ggaaatctat  1140
tccttcgggc gagtgcctta cccaagaatt ccctgaagg acgtcgtccc tcgggtggaa   1200
```

TABLE 1-continued

```
aagggctata agatggacgc tccggatggc tgcccgcccg cagtctacga ggtgatgaag    1260
aactgctggc acctggatgc tgccacacgg cccacgtttt tgcagcttcg ggaacagctc    1320
gagcacatca agacccatga gctgcacctg tga                                 1353
```

SEQ ID NO: 12 *Mus musculus* c-src tyrosine kinase (CSK) cDNA,
transcript variant X2 (XM_006510801)

```
atgtcggcaa tacaggccgc ctggccatcc ggtacagaat gtattgccaa gtacaacttc      60
catggcactg ctgagcaaga ccttcccttc tgcaaaggag atgtgctcac catcgtggct     120
gtcaccaagg accccaactg gtacaaagcc aaaaacaaag tgggccgtga gggcatcatc     180
ccagccaact atgtccagaa gcgtgagggt gtgaaggcag gcaccaaact cagccttatg     240
ccctggttcc acggcaagat cacacgggag caggccgagc ggcttcttta ccccaccaga     300
acaggcctgt tcctcgtgcg ggaaagcacc aactaccctg gagactacac actgtgtgtg     360
agctgtgagg gcaaggtgga gcactaccgc atcatgtatc atgcgagcaa gctgagcatt     420
gatgaggagg tgtactttga aaacctcatg cagctggtgg agcactacac cacagatgcc     480
gatggactct gcactcgcct catcaaacca aaggtcatgg agggcaccgt ggcggcccag     540
gatgagttct accgcagtgg ctgggcactg aacatgaagg aactgaagct gctacagaca     600
atagggaagg gggagtttgg agatgtgatg ctgggggatt accggggcaa caaagttgca     660
gtcaagtgca tcaagaatga cgcaactgcc caggccttcc tggctgaagc ctccgtcatg     720
acgcaacttc ggcacagcaa cctcgtccag ctgctgggtg tgattgtgga ggagaagggt     780
gggctctaca tcgtcacaga gtacatggcc aaggggactt tggtggacta tcttcgatca     840
cgtggtcgtt cggtgctagg tggagactgt ctcctcaaat tctcattaga cgtctgtgaa     900
gccatggagt acctggaggg taacaatttt gtgcaccggg acttggctgc ccggaatgtg     960
ctggtgtctg aagacaacgt ggccaaagtc agtgactttg gcctcactaa ggaagcctcc    1020
agcactcagg acacaggcaa gctgccagtc aaatggacag cccctgaagc cttgagagag    1080
aagaaatttt ccaccaagtc tgatgtgtgg agtttcggaa tccttctctg ggaaatctat    1140
tccttcgggc gagtgcctta cccaagaatt cccctgaagg acgtcgtccc tcgggtggaa    1200
aagggctata agatggacgc tccggatggc tgcccgcccg cagtctacga ggtgatgaag    1260
aactgctggc acctggatgc tgccacacgg cccacgtttt tgcagcttcg ggaacagctc    1320
gagcacatca agacccatga gctgcacctg tga                                 1353
```

SEQ ID NO: 13 *Mus musculus* c-src tyrosine kinase (CSK) cDNA,
transcript variant X3 (XM_011242659)

```
atgtcggcaa tacaggccgc ctggccatcc ggtacagaat gtattgccaa gtacaacttc      60
catggcactg ctgagcaaga ccttcccttc tgcaaaggag atgtgctcac catcgtggct     120
gtcaccaagg accccaactg gtacaaagcc aaaaacaaag tgggccgtga gggcatcatc     180
ccagccaact atgtccagaa gcgtgagggt gtgaaggcag gcaccaaact cagccttatg     240
ccctggttcc acggcaagat cacacgggag caggccgagc ggcttcttta ccccaccaga     300
acaggcctgt tcctcgtgcg ggaaagcacc aactaccctg gagactacac actgtgtgtg     360
agctgtgagg gcaaggtgga gcactaccgc atcatgtatc atgcgagcaa gctgagcatt     420
gatgaggagg tgtactttga aaacctcatg cagctggtgg agatcaggac acaaaggttc     480
ggatcagcga agatccccct gtctacgcat tggaggtgtc tgtctgatcc agacctcact     540
tcctccagca ctcagaacct catgtcggga tgtgtacatt gccgtcaagg tcctggaggc     600
aggcacacag gtccttgctg cttccaacac cggctccacc cgttccagcc aggccatatc     660
tggcatcaaa gacccatagg ttcctctgag ctcactctca tctctggccc gccctgtccc     720
tga                                                                   723
```

SEQ ID NO: 14 *Mus musculus* c-src tyrosine-protein kinase (CSK)
amino acid sequence (NP_001291690)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCEGKVEHYR IMYHASKLSI DEEVYFENLM QLVEHYTTDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGGDC LLKFSLDVCE     300
AMEYLEGNNF VHRDLAARNV LVSEDNVAKV SDFGLTKEAS STQDTGKLPV KWTAPEALRE     360
KKFSTKSDVW SFGILLWEIY SFGRVPYPRI PLKDVVPRVE KGYKMDAPDG CPPAVYEVMK     420
NCWHLDAATR PTFLQLREQL EHIKTHELHL                                     450
```

SEQ ID NO: 15 *Mus musculus* c-src tyrosine-protein kinase (CSK)
amino acid sequence (NP_031809)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCEGKVEHYR IMYHASKLSI DEEVYFENLM QLVEHYTTDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGGDC LLKFSLDVCE     300
AMEYLEGNNF VHRDLAARNV LVSEDNVAKV SDFGLTKEAS STQDTGKLPV KWTAPEALRE     360
KKFSTKSDVW SFGILLWEIY SFGRVPYPRI PLKDVVPRVE KGYKMDAPDG CPPAVYEVMK     420
NCWHLDAATR PTFLQLREQL EHIKTHELHL                                     450
```

SEQ ID NO: 16 *Mus musculus* c-src tyrosine-protein kinase (CSK)
amino acid sequence, isoform X1 (XP_006510864)

```
MSAIQAAWPS GTECIAKYNF HGTAEQDLPF CKGDVLTIVA VTKDPNWYKA KNKVGREGII      60
PANYVQKREG VKAGTKLSLM PWFHGKITRE QAERLLYPPE TGLFLVREST NYPGDYTLCV     120
SCEGKVEHYR IMYHASKLSI DEEVYFENLM QLVEHYTTDA DGLCTRLIKP KVMEGTVAAQ     180
DEFYRSGWAL NMKELKLLQT IGKGEFGDVM LGDYRGNKVA VKCIKNDATA QAFLAEASVM     240
TQLRHSNLVQ LLGVIVEEKG GLYIVTEYMA KGSLVDYLRS RGRSVLGGDC LLKFSLDVCE     300
```

TABLE 1-continued

```
AMEYLEGNNF VHRDLAARNV LVSEDNVAKV SDFGLTKEAS STQDTGKLPV KWTAPEALRE    360
KKFSTKSDVW SFGILLWEIY SFGRVPYPRI PLKDVVPRVE KGYKMDAPDG CPPAVYEVMK    420
NCWHLDAATR PTFLQLREQL EHIKTHELHL                                    450
```

SEQ ID NO: 17 *Mus musculus* c-src tyrosine-protein kinase (CSK)
amino acid sequence, isoform X1 (XP_006510865)

```
MSAIQAAWPS GTECIAKYNF HGTAEQDLPF CKGDVLTIVA VTKDPNWYKA KNKVGREGII     60
PANYVQKREG VKAGTKLSLM PWFHGKITRE QAERLLYPPE TGLFLVREST NYPGDYTLCV    120
SCEGKVEHYR IMYHASKLSI DEEVYFENLM QLVEHYTTDA DGLCTRLIKP KVMEGTVAAQ    180
DEFYRSGWAL NMKELKLLQT IGKGEFGDVM LGDYRGNKVA VKCIKNDATA QAFLAEASVM    240
TQLRHSNLVQ LLGVIVEEKG GLYIVTEYMA KGSLVDYLRS RGRSVLGGDC LLKFSLDVCE    300
AMEYLEGNNF VHRDLAARNV LVSEDNVAKV SDFGLTKEAS STQDTGKLPV KWTAPEALRE    360
KKFSTKSDVW SFGILLWEIY SFGRVPYPRI PLKDVVPRVE KGYKMDAPDG CPPAVYEVMK    420
NCWHLDAATR PTFLQLREQL EHIKTHELHL                                    450
```

SEQ ID NO: 18 *Mus musculus* c-src tyrosine-protein kinase (CSK)
amino acid sequence, isoform X2 (XP_011240961)

```
MSAIQAAWPS GTECIAKYNF HGTAEQDLPF CKGDVLTIVA VTKDPNWYKA KNKVGREGII     60
PANYVQKREG VKAGTKLSLM PWFHGKITRE QAERLLYPPE TGLFLVREST NYPGDYTLCV    120
SCEGKVEHYR IMYHASKLSI DEEVYFENLM QLVEIRTQRF GSAKIPSSTH WRCLSDPDLT    180
SSSTQNLMSG CVHCRQGPGG RHTGPCCFQH RLHPFQPGHI WHQRPIGSSE LTLISGPPCP    240
```

SEQ ID NO: 19 *Pan troglodytes* (chimpanzee) c-src tyrosine kinase
(CSK) cDNA (XM_016927198)

```
atgtcagcaa tacaggccgc ctggccatcc ggtacagaat gtattgccaa gtacaacttc     60
cacggcactg ccgagcagga cctgcccttc tgcaaaggag acgtgctcac cattgtggcc    120
gtcaccaagg accccaactg gtacaaagcc aaaaacaagg tgggccgtga gggcatcatc    180
ccagccaact acgtccagaa gcgggagggc gtgaaggcgg taccaaact cagcctcatg    240
ccttggttcc acggcaagat cacacgggag caggctgagc ggcttctgta cccgccggag    300
acaggcctgt tcctggtgcg ggagagcacc aactacccg gagactacac gctgtgcgtg    360
agctgcgacg gcaaggtgga gcactaccgc atcatgtacc atgccagcaa gctcagcatc    420
gacgaggagg tgtactttga gaacctcatg cagctggtgg agcactacac ctcagacgca    480
gatggactct gtacgcgcct cattaaacca aaggtcatgg agggcacagt ggcggcccag    540
gatgagttct accgcagcgg ctgggccctg aacatgaagg agctgaagct gctgcagacc    600
atcgggaagg gggagttcgg agacgtgatg ctgggcgatt accgagggaa caaagtcgct    660
gtcaagtgca ttaagaacga cgccactgcc caggccttcc tggctgaagc ctcagtcatg    720
acgcaactgc ggcatagcaa cctggtgcag ctcctggggcg tgatcgtgga ggagaagggc    780
gggctctaca tcgtcactga gtacatggcc aaggggagcc tcgtggacta cctgcggtct    840
cggggtcggt cagtgctggg cggagactgt ctcctcaagt tctcgctaga tgtctgcgag    900
gccatggaat acctggaggg caacaatttc gtgcatcgag acctggctgc ccgcaatgtg    960
ctggtgtctg aggacaacgt ggccaaggtc agcgactttg gtctcaccaa ggaggcgtcc   1020
agcacccagg acacgggcaa gctgccagtc aagtggacag cccctgaggc cctgagagag   1080
aagaaattct ccactaagtc tgacgtgtgg agtttcggat tccttctctg ggaaatctat   1140
tcctttgggc gagtgcctta tccaagaatt ccctgaagg acgtcgtccc tcgggtggag   1200
aagggctaca gatggatgc ccccgacggc tgcccgcccg cagtctatga ggtcatgaag   1260
aactgctggc acctggacgc cgccatgcgg ccctccttcc tacagctccg agagcagctt   1320
gagcacatca aaacccacga gctgcacctg tga                                1353
```

SEQ ID NO: 20 *Pan troglodytes* (chimpanzee) c-src tyrosine kinase
(CSK) amino acid sequence (XP_016782687)

```
MSAIQAAWPS GTECIAKYNF HGTAEQDLPF CKGDVLTIVA VTKDPNWYKA KNKVGREGII     60
PANYVQKREG VKAGTKLSLM PWFHGKITRE QAERLLYPPE TGLFLVREST NYPGDYTLCV    120
SCDGKVEHYR IMYHASKLSI DEEVYFENLM QLVEHYTSDA DGLCTRLIKP KVMEGTVAAQ    180
DEFYRSGWAL NMKELKLLQT IGKGEFGDVM LGDYRGNKVA VKCIKNDATA QAFLAEASVM    240
TQLRHSNLVQ LLGVIVEEKG GLYIVTEYMA KGSLVDYLRS RGRSVLGGDC LLKFSLDVCE    300
AMEYLEGNNF VHRDLAARNV LVSEDNVAKV SDFGLTKEAS STQDTGKLPV KWTAPEALRE    360
KKFSTKSDVW SFGILLWEIY SFGRVPYPRI PLKDVVPRVE KGYKMDAPDG CPPAVYEVMK    420
NCWHLDAAMR PSFLQLREQL EHIKTHELHL                                    450
```

SEQ ID NO: 21 *Macaca mulatta* (Rhesus macaque) c-src tyrosine kinase
(CSK) cDNA (NM_001261636)

```
atgtcagcaa tacaggcctc ctggccatcc ggtacagaat gtattgccaa gtacaacttc     60
cacggcaccg ccgagcaaga cctgcctttc tgcaaaggag acgtgctcac cattgtggcc    120
gtcaccaagg accccaactg gtacaaagcc aaaaacaagg tgggccgtga gggcatcatc    180
ccagccaact acgtccagaa gcgggagggc gtgaaggcgg taccaaaact cagcctcatg    240
ccttggttcc acggcaagat cacacgggag caggctgagc ggcttctgta cccgccggag    300
acaggcctgt tcctggtgcg ggagagcacc aactacctg gggactacac gctgtgcgtg    360
agctgcgatg caaggtgga gcactaccgc atcatgtacc atgccagcaa gctcagcatc    420
gacgaggagg tgtactttga gaatctcatg cagctggtgg agcactacac ctcagacgca    480
gatggactct gtacgcgcct cattaaacca aaggtcatgg agggcacggt ggcggcccag    540
gatgagttct accgcagcgg ctgggccctg aacatgaagg agctgaagct actgcagacc    600
attgggaagg gggagttcgg agacgtgatg ctgggcgatt accgagggaa caaagtcgct    660
gtcaagtgca ttaagaacga cgccaccgcc caggccttcc tggctgaagc ttcagtcatg    720
acgcaactgc ggcatagcaa cctggtgcag ctcctggggcg tgatcgtgga ggagaagggc    780
gggctctaca tcgtcactga gtacatggcc aaggggagcc tcgtggacta cctgcggtct    840
```

TABLE 1-continued

```
cggggtcggt cagtgctggg cggagactgt ctcctcaagt tctcgctaga tgtctgcgag    900
gccatggaat acctggaggg caacaacttc gtgcatcgag acctggctgc ccgcaacgtg    960
ctggtgtctg aggacaacgt ggccaaggtc agcgactttg gtctcaccaa ggaggcgtcc   1020
agcacccagg acacgggcaa gctgccagtc aagtggacag cccctgaggc cctgagagag   1080
aagaaattct ccactaagtc tgacgtgtgg agtttcggaa tccttctctg ggaaatctac   1140
tcctttgggc gagtgcctta tccaagaatt ccctgaaggg acgtcgtccc tcgggtggag   1200
aagggctaca agatggatgc ccccgatggc tgcccgcccg cagtctatga ggtcatgaag   1260
aactgctggc acctggacgc cgccatgcgg ccatccttcc tacagctccg agagcagctt   1320
gagcacatca aaacccatga gctgcaccct tga                                1353
```

SEQ ID NO: 22 *Macaca mulatta* (Rhesus macaque) c-src tyrosine kinase
(CSK) amino acid sequence (NP_001248565)

```
MSAIQASWPS GTECIAKYNF HGTAEQDLPF CKGDVLTIVA VTKDPNWYKA KNKVGREGII    60
PANYVQKREG VKAGTKLSLM PWFHGKITRE QAERLLYPPE TGLFLVREST NYPGDYTLCV   120
SCDGKVEHYR IMYHASKLSI DEEVYFENLM QLVEHYTSDA DGLCTRLIKP KVMEGTVAAQ   180
DEFYRSGWAL NMKELKLLQT IGKGEFGDVM LGDYRGNKVA VKCIKNDATA QAFLAEASVM   240
TQLRHSNLVQ LLGVIVEEKG GLYIVTEYMA KGSLVDYLRS RGRSVLGGDC LLKFSLDVCE   300
AMEYLEGNNF VHRDLAARNV LVSEDNVAKV SDEGLTKEAS STQDTGKLPV KWTAPEALRE   360
KKFSTKSDVW SFGILLWEIY SFGRVPYPRI PLKDVVPRVE KGYKMDAPDG CPPAVYEVMK   420
NCWHLDAAMR PSFLQLREQL EHIKTHELHL                                   450
```

SEQ ID NO: 23 *Canis lupus familiaris* (dog) c-src tyrosine kinase
(CSK) cDNA, transcript variant X1 (XM_544774)

```
atgtcagcaa tccaggccgc ctggccatcc ggtacagaat gtattgccaa gtacaatttc    60
catggcactg ccgagcagga ccttcccttc tgcaaaggag acgtgctcac cattgtggcg   120
gtcaccaagg acccaaactg gtacaaagcc aagaacaagg tgggccgtga gggcatcatc   180
ccagccaact acgtccagaa acgggagggc gtgaaggccg gcaccaagct cagcctcatg   240
ccctggttcc atggcaagat cacgcgggag caggccgagc ggctgctgtg cccgcccgag   300
accggcctgt tcctggtgcg ggagagcacc aactacccgg gggactacac gctgtgcgtg   360
agctgtgacg gcaaggtgga gcactaccgc atcatgtacc acgccagcaa gctcagcatc   420
gacgaggagg tgtacttcga gaacctcatg cagctggtgg agcactacac ctcggacgcg   480
gacggactct gtactcgcct catcaagcca aaggtcatgg agggcacggt ggccgcccag   540
gatgagttct ccgcagcgg ctgggcactg aacatgaagg acctgaagct gctgcagacc   600
attgggaagg gggagtttgg agacgtgatg ctaggcgatt accgagggaa caaggttgct   660
gtcaagtgca ttaaaaatga cgccactgcc caggcctttc tggctgaagc ctctgtgatg   720
acgcaacttc ggcatagcaa cctggtacag cttctgggtg tgatcgtgga agagaagggc   780
gggctgtaca ttgtcacgga gtacatggcc aagggaagcc tggtgactta tctgcggtca   840
agggtcgat cggtgctggg cggagactgt ctcctcaagt tctcactaga tgtctgtgag   900
gccatggaat acctggaggg caacaacttc gtgcaccggg atctggctgc ccgcaacgtg   960
ctggtgtctg aagacaacgt ggccaaggtc agcgactttg gcctcaccaa ggaggcctcc  1020
agcacccagg acacgggcaa gctgccagtc aagtggacgg ccccggaggc cctgagagag  1080
aagaaattct ccaccaagtc tgacgtgtgg agtttcggaa tccttctctg ggaaatctac  1140
tcctttgggc gagtgcctta cccaagaatt cccctgaagg acgtcgtccc tcgggtggag  1200
aagggctaca agatggacgc ccccgacggc tgcccacctg cggtctacga ggtcatgaag  1260
aactgctggc acctggatgc tgccacaagg ccctccttcc tgcagctccg ggagcagctc  1320
gagcacatca aacccacga gttgcaccct tga                                1353
```

SEQ ID NO: 24 *Canis lupus familiaris* (dog) c-src tyrosine kinase
(CSK) cDNA, transcript variant X2 (XM_005638624)

```
atgtcagcaa tccaggccgc ctggccatcc ggtacagaat gtattgccaa gtacaatttc    60
catggcactg ccgagcagga ccttcccttc tgcaaaggag acgtgctcac cattgtggcg   120
gtcaccaagg acccaaactg gtacaaagcc aagaacaagg tgggccgtga gggcatcatc   180
ccagccaact acgtccagaa acgggagggc gtgaaggccg gcaccaagct cagcctcatg   240
ccctggttcc atggcaagat cacgcgggag caggccgagc ggctgctgtg cccgcccgag   300
accggcctgt tcctggtgcg ggagagcacc aactacccgg gggactacac gctgtgcgtg   360
agctgtgacg gcaaggtgga gcactaccgc atcatgtacc acgccagcaa gctcagcatc   420
gacgaggagg tgtacttcga gaacctcatg cagctggtgg agcactacac ctcggacgcg   480
gacggactct gtactcgcct catcaagcca aaggtcatgg agggcacggt ggccgcccag   540
gatgagttct ccgcagcgg ctgggcactg aacatgaagg acctgaagct gctgcagacc   600
attgggaagg gggagtttgg agacgtgatg ctaggcgatt accgagggaa caaggttgct   660
gtcaagtgca ttaaaaatga cgccactgcc caggcctttc tggctgaagc ctctgtgatg   720
acgcaacttc ggcatagcaa cctggtacag cttctgggtg tgatcgtgga agagaagggc   780
gggctgtaca ttgtcacgga gtacatggcc aagggaagcc tggtgactta tctgcggtca   840
agggtcgat cggtgctggg cggagactgt ctcctcaagt tctcactaga tgtctgtgag   900
gccatggaat acctggaggg caacaacttc gtgcaccggg atctggctgc ccgcaacgtg   960
ctggtgtctg aagacaacgt ggccaaggtc agcgactttg gcctcaccaa ggaggcctcc  1020
agcacccagg acacgggcaa gctgccagtc aagtggacgg ccccggaggc cctgagagag  1080
aagaaattct ccaccaagtc tgacgtgtgg agtttcggaa tccttctctg ggaaatctac  1140
tcctttgggc gagtgcctta cccaagaatt cccctgaagg acgtcgtccc tcgggtggag  1200
aagggctaca agatggacgc ccccgacggc tgcccacctg cggtctacga ggtcatgaag  1260
aactgctggc acctggatgc tgccacaagg ccctccttcc tgcagctccg ggagcagctc  1320
gagcacatca aacccacga gttgcaccct tga                                1353
```

TABLE 1-continued

SEQ ID NO: 25 *Canis lupus familiaris* (dog) c-src tyrosine kinase
(CSK) cDNA, transcript variant X3 (XM_005638625)

```
atgtcagcaa tccaggccgc ctggccatcc ggtacagaat gtattgccaa gtacaatttc    60
catggcactg ccgagcagga ccttcccttc tgcaaaggag acgtgctcac cattgtggcg   120
gtcaccaagg acccaaactg gtacaaagcc aagaacaagg tgggccgtga gggcatcatc   180
ccagccaact acgtccagaa acgggagggc gtgaaggccg gcaccaagct cagcctcatg   240
ccctggttcc atggcaagat cacgcgggag caggccgagc ggctgctgtg cccgcccgag   300
accggcctgt tcctggtgcg ggagagcacc aactacccgg gggactacac gctgtgcgtg   360
agctgtgacg gcaaggtgga gcactaccgc atcatgtacc acgccagcaa gctcagcatc   420
gacgaggagg tgtacttcga aacctcatg cagctggtgg agcactacac ctcggacgcg   480
gacggactct gtactcgcct catcaagcca aaggtcatgg agggcacggt ggccgcccaa   540
gatgagttct tccgcagcgg ctgggcactg aacatgaagg acctgaagct gctgcagacc   600
attgggaagg gggagtttgg agacgtgatg ctaggcgatt accgagggaa caaggttgct   660
gtcaagtgca ttaaaaatga cgccactgcc caggcctttc tggctgaagc ctctgtgatg   720
acgcaacttc ggcatagcaa cctggtacag cttctggtgg tgatcgtgga agagaagggc   780
gggctgtaca ttgtcacgga gtacatggcc aagggaagcc tggtggacta tctgcggtca   840
aggggtcgat cggtgctggg cggagactgt ctcctcaagt tctcactaga tgtctgtgag   900
gccatggaat acctggaggg caacaacttc gtgcaccggg atctggctgc cgcaacgtg   960
ctggtgtctg aagacaacgt ggccaaggtc agcgacttg gcctcaccaa ggaggcctcc  1020
agcacccagg acacgggcaa gctgccagtc aagtggacgg ccccggaggc cctgagagag  1080
aagaaattct ccaccaagtc tgacgtgtgg agtttcggaa tccttctctg ggaaatctac  1140
tcctttgggc gagtgcctta cccaagaatt cccctgaagg acgtcgtccc tcgggtggag  1200
aagggctaca agatggacgc ccccgacggc tgcccacctg cggtctacga ggtcatgaag  1260
aactgctggc acctggatgc tgccacaagg ccctccttcc tgcagctccg ggagcagctc  1320
gagcacatca aaacccacga gttgcacctg tga                               1353
```

SEQ ID NO: 26 *Canis lupus familiaris* (dog) c-src tyrosine kinase
(CSK) amino acid sequence (XP_005638682)

```
MSAIQAAWPS GTECIAKYNF HGTAEQDLPF CKGDVLTIVA VTKDPNWYKA KNKVGREGII    60
PANYVQKREG VKAGTKLSLM PWFHGKITRE QAERLLCPPE TGLFLVREST NYPGDYTLCV   120
SCDGKVEHYR IMYHASKLSI DEEVYFENLM QLVEHYTSDA DGLCTRLIKP KVMEGTVAAQ   180
DEFFRSGWAL NMKDLKLLQT IGKGEFGDVM LGDYRGNKVA VKCIKNDATA QAFLAEASVM   240
TQLRHSNLVQ LLGVIVEEKG GLYIVITYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYEVMK   420
NCWHLDAATR PSFLQLREQL EHIKTHELHL                                    450
```

SEQ ID NO: 27 *Canis lupus familiaris* (dog) c-src tyrosine kinase
(CSK) amino acid sequence (XP_005638681)

```
MSAIQAAWPS GTECIAKYNF HGTAEQDLPF CKGDVLTIVA VTKDPNWYKA KNKVGREGII    60
PANYVQKREG VKAGTKLSLM PWFHGKITRE QAERLLCPPE TGLFLVREST NYPGDYTLCV   120
SCDGKVEHYR IMYHASKLSI DEEVYFENLM QLVEHYTSDA DGLCTRLIKP KVMEGTVAAQ   180
DEFFRSGWAL NMKDLKLLQT IGKGEFGDVM LGDYRGNKVA VKCIKNDATA QAFLAEASVM   240
TQLRHSNLVQ LLGVIVEEKG GLYIVTEYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYEVMK   420
NCWHLDAATR PSFLQLREQL EHIKTHELHL                                    450
```

SEQ ID NO: 28 *Canis lupus familiaris* (dog) c-src tyrosine kinase
(CSK) amino acid sequence (XP_544774)

```
MSAIQAAWPS GTECIAKYNF HGTAEQDLPF CKGDVLTIVA VTKDPNWYKA KNKVGREGII    60
PANYVQKREG VKAGTKLSLM PWFHGKITRE QAERLLCPPE TGLFLVREST NYPGDYTLCV   120
SCDGKVEHYR IMYHASKLSI DEEVYFENLM QLVEHYTSDA DGLCTRLIKP KVMEGTVAAQ   180
DEFFRSGWAL NMKDLKLLQT IGKGEFGDVM LGDYRGNKVA VKCIKNDATA QAFLAEASVM   240
TQLRHSNLVQ LLGVIVEEKG GLYIVTEYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYEVMK   420
NCWHLDAATR PSFLQLREQL EHIKTHELHL                                    450
```

SEQ ID NO: 29 *Bos taurus* (cow) c-src tyrosine kinase (CSK) cDNA
(NM_001075397)

```
atgtcagcaa ttcaggctgc ctggccatcc ggtacagaat gtattgccaa gtacaacttt    60
cacggcactg ctgagcaaga ccttcccttc tgcaaaggag atgtgctcac cattgtggct   120
gtcaccaagg accccaattg gtacaaagcc aagaacaagg tgggccgtga gggcatcatc   180
ccagccaact atgtccagaa gcgggagggt gtgaaggccg gcaccaagct cagcctcatg   240
ccctggttcc atggcaagat cacgcgggaa caggccgagc ggctcctgtg cccaccggag   300
acaggcctgt tcctggtgcg ggagagcacc aactacccg gggactacac gctgtgcgtg   360
agctgtgatg gcaaggtgga gcattaccgc atcatgtacc acgccagcaa gctcagcatc   420
gatgaagagg tgtactttga aacctcatg cagctggtgg agcactacac ctcagatgca   480
gatggcctct gtactcgcct catcaagcca aaggtcatgg agggcacggt ggccgcccag   540
gatgagttct tccgcagtgg ctgggcgctg aacatgaagg acctgaagct gctgcagacc   600
atagggaagg gggagtttgg agacgtgatg ctgggtgact accgagggaa caaagtcgct   660
gtcaagtgca ttaagaacga tgccactgca caggcctccc tggctgaagc ctccgtcatg   720
acgcaactcc ggcatagcaa cctggtacag cttctggggc tgatcgtaga ggagaagagc   780
```

TABLE 1-continued

```
gggctgtaca tcgttaccga gtacatggcc aaggggagtc tagtggacta cctgcggtct   840
cggggtcggt cggtgcttgg cggagactgt ctcctcaagt tctcactaga cgtctgtgag   900
gccatggaat acctggaggg caacaacttc gtgcatcggg atctggctgc cgcaacgtg    960
ctggtgtctg aggacaatgt ggccaaggtc agcgacttcg gcctcaccaa ggaggcctcc  1020
agcacccagg acacgggcaa gctgccggtc aagtggacag ccccgaggc cctaagagag   1080
aagaaattct ccaccaagtc tgatgtgtgg agtttcggga tccttctctg ggaaatctac  1140
tctttcgggc gagtgcctta tccaagaatt cccctgaagg acgtcgtccc gcgggtggag  1200
aagggctaca agatggatgc ccctgacggc tgcccacctg cagtctacga ggtcatgaag  1260
aactgctggc acctggatgc cgccacgcgg ccctccttcc tgcagctccg cgagcagctc  1320
gagcgcatca agacccacga gctgcacctg tga                               1353
```

SEQ ID NO: 30 *Bos taurus* (cow) c-src tyrosine kinase (CSK) amino
acid sequence (NP_001068865)

```
MSAIQAAWPS GTECIAKYNF HGTAEQDLPF CKGDVLTIVA VTKDPNWYKA KNKVGREGII    60
PANYVQKREG VKAGTKLSLM PWFHGKITRE QAERLLCPPE TGLFLVREST NYPGDYTLCV   120
SCDGKVEHYR IMYHASKLSI DEEVYFENLM QLVEHYTSDA DGLCTRLIKP KVMEGTVAAQ   180
DEFFRSGWAL NMKDLKLLQT IGKGEFGDVM LGDYRGNKVA VKCIKNDATA QAFLAEASVM   240
TQLRHSNLVQ LLGVIVEEKS GLYIVTEYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYEVMK   420
NCWHLDAATR PSFLQLREQL ERIKTHELHL                                   450
```

SEQ ID NO: 31 *Rattus norvegicus* (rat) c-src tyrosine kinase (CSK)
cDNA (NM_001030039)

```
atgtcggcta tacaggcctc ctggccatcc ggtacagaat gtattgccaa gtacaacttc    60
catggcactg ccgagcaaga ccttcccttc tgcaaaggaa atgtgctcac cattgtggct   120
gtcaccaagg accccaactg gtacaaagcc aaaaacaaag tgggccgtga gggcatcatc   180
ccagccaact atgtccagaa gcgtgagggt gtgaaggcag gcaccaagct cagccttatg   240
ccctggttcc acggcaagat cacacgggag caggcggagc ggcttctcta cccaccagag   300
acaggcctgt tcctggtgcg ggaaagcacc aactacctg gggactacac actgtgtgtg    360
agctgtgaag gcaaggtgga gcactaccgc atcatgtatc acgcgagcaa gctgagcatt   420
gatgaggagg tgtacttcga gaacctcatg cagctggtgg agcactacac cacagatgcc   480
gacggactct gcactcgcct catcaaacca aaggtcatgg agggcacagt ggcggcccaa   540
gatgaattct accgcagtgg ctgggccctg aacatgaagg aactgaagct gctacagacg   600
ataggaaagg gggagtttgg agatgtgatg ctggggatt accgaggcaa caaagttgca   660
gtcaagtgca ttaagaatga tgctacagcc caggccttcc tggctgaagc ctctgtcatg   720
acgcagcttc ggcacagcaa cctagtccag ctactgggtg tgattgtgga ggagaaggt    780
gggctctaca tcgtcacaga gtacatggcc aaggggagtt tggtggacta tcttcgatca   840
cgtggtcgtt cggtgctagg cggagactgt ctcctcaaat tctcactaga cgtctgtgaa   900
gccatggagt acctggaggg taacaatttt gtgcaccggg acttggctgc cggaatgtg    960
ctggtgtctg aggacaacgt ggccaaagtc agtgactttg gcctcactaa ggaagcttcc  1020
agcactcagg acacaggcaa actgccagtc aagtggacag ctcctgaagc cttgagagag  1080
aagaaattt ccaccaagtc tgatgtgtgg agtttcggaa tccttctctg ggaaatctat   1140
tccttcgggc gagtgcctta cccaagaatt cccctgaagg acgtcgtccc tcgggtggaa  1200
aagggctata agatggacgc tccggatggc tgcccacccg cagtctatga tgttatgaag  1260
aactgctggc acctggatgc tgccacgcgg cccaccttc tgcagcttcg agagcagctc   1320
gagcacatca gaacccatga gctgcacctg tga                               1353
```

SEQ ID NO: 32 *Rattus norvegicus* (rat) c-src tyrosine kinase (CSK)
cDNA, transcript variant X1 (XM_006243163)

```
atgtcggcta tacaggcctc ctggccatcc ggtacagaat gtattgccaa gtacaacttc    60
catggcactg ccgagcaaga ccttcccttc tgcaaaggaa atgtgctcac cattgtggct   120
gtcaccaagg accccaactg gtacaaagcc aaaaacaaag tgggccgtga gggcatcatc   180
ccagccaact atgtccagaa gcgtgagggt gtgaaggcag gcaccaagct cagccttatg   240
ccctggttcc acggcaagat cacacgggag caggcggagc ggcttctcta cccaccagag   300
acaggcctgt tcctggtgcg ggaaagcacc aactacctg gggactacac actgtgtgtg    360
agctgtgaag gcaaggtgga gcactaccgc atcatgtatc acgcgagcaa gctgagcatt   420
gatgaggagg tgtacttcga gaacctcatg cagctggtgg agcactacac cacagatgcc   480
gacggactct gcactcgcct catcaaacca aaggtcatgg agggcacagt ggcggcccaa   540
gatgaattct accgcagtgg ctgggccctg aacatgaagg aactgaagct gctacagacg   600
ataggaaagg gggagtttgg agatgtgatg ctggggatt accgaggcaa caaagttgca   660
gtcaagtgca ttaagaatga tgctacagcc caggccttcc tggctgaagc ctctgtcatg   720
acgcagcttc ggcacagcaa cctagtccag ctactgggtg tgattgtgga ggagaaggt    780
gggctctaca tcgtcacaga gtacatggcc aaggggagtt tggtggacta tcttcgatca   840
cgtggtcgtt cggtgctagg cggagactgt ctcctcaaat tctcactaga cgtctgtgaa   900
gccatggagt acctggaggg taacaatttt gtgcaccggg acttggctgc cggaatgtg    960
ctggtgtctg aggacaacgt ggccaaagtc agtgactttg gcctcactaa ggaagcttcc  1020
agcactcagg acacaggcaa actgccagtc aagtggacag ctcctgaagc cttgagagag  1080
aagaaattt ccaccaagtc tgatgtgtgg agtttcggaa tccttctctg ggaaatctat   1140
tccttcgggc gagtgcctta cccaagaatt cccctgaagg acgtcgtccc tcgggtggaa  1200
aagggctata agatggacgc tccggatggc tgcccacccg cagtctatga tgttatgaag  1260
aactgctggc acctggatgc tgccacgcgg cccaccttc tgcagcttcg agagcagctc   1320
gagcacatca gaacccatga gctgcacctg tga                               1353
```

TABLE 1-continued

SEQ ID NO: 33 *Rattus norvegicus* (rat) c-src tyrosine kinase (CSK)
cDNA, transcript variant X2 (XM_006243164)

```
atgtcggcta tacaggcctc ctggccatcc ggtacagaat gtattgccaa gtacaacttc    60
catggcactg ccgagcaaga ccttcccttc tgcaaaggag atgtgctcac cattgtggct   120
gtcaccaagg accccaactg gtacaaagcc aaaaacaaag tgggccgtga gggcatcatc   180
ccagccaact atgtccagaa gcgtgagggt gtgaaggcag gcaccaagct cagccttatg   240
ccctggttcc acggcaagat cacacgggag caggcggagc ggcttctcta cccaccagag   300
acaggcctgt tcctggtgcg ggaaagcacc aactaccctg gggactacac actgtgtgtg   360
agctgtgaag gcaaggtgga gcactaccgc atcatgtatc acgcgagcaa gctgagcatt   420
gatgaggagg tgtacttcga gaacctcatg cagctggtgg agcactacac cacagatgcc   480
gacggactct gcactcgcct catcaaacca aaggtcatgg agggcacagt ggcggcccaa   540
gatgaattct accgcagtgg ctgggccctg aacatgaagg aactgaagct gctacagacg   600
ataggaaagg gggagtttgg agatgtgatg ctggggatt accgaggcaa caaagttgca   660
gtcaagtgca ttaagaatga tgctacagcc caggccttcc tggctgaagc ctctgtcatg   720
acgcagcttc ggcacagcaa cctagtccag ctactgggtg tgattgtgga ggagaaggg t   780
gggctctaca tcgtcacaga gtacatggcc aaggggagtt tggtggacta cttcgatca    840
cgtggtcgtt cggtgctagg cggagactgt ctccctcaaat tctcactaga cgtctgtgaa   900
gccatggagt acctggaggg taacaatttt gtgcaccggg acttggctgc ccggaatgtg   960
ctggtgctcg aggacaacgt ggccaaagtc agtgactttg gcctcactaa ggaagcttcc  1020
agcactcagg acacaggcaa actgccagtc aagtggacag ctcctgaagc cttgagagag  1080
aagaaatttt ccaccaagtc tgatgtgtgg agtttcggaa tccttctctg ggaaatctat  1140
tccttcgggc gagtgcctta cccaagaatt ccccctgaagg acgtcgtccc tcgggtggaa  1200
aagggctata gatggacgc tccggatggc tgcccacccg cagtctatga tgttatgaag  1260
aactgctggc acctggatgc tgccacgcgg cccaccttcc tgcagcttcg agagcagctc  1320
gagcacatca gaacccatga gctgcacctg tga                                1353
```

SEQ ID NO: 34 *Rattus norvegicus* (rat) c-src tyrosine kinase (CSK)
amino acid sequence (NP_001025210)

```
MSAIQASWPS GTECIAKYNF HGTAEQDLPF CKGDVLTIVA VTKDPNWYKA KNKVGREGII    60
PANYVQKREG VKAGTKLSLM PWFHGKITRE QAERLLYPPE TGLFLVREST NYPGDYTLCV   120
SCEGKVEHYR IMYHASKLSI DEEVYFENLM QLVEHYTTDA DGLCTRLIKP KVMEGTVAAQ   180
DEFYRSGWAL NMKELKLLQT IGKGEFGDVM LGDYRGNKVA VKCIKNDATA QAFLAEASVM   240
TQLRHSNLVQ LLGVIVEEKG GLYIVTEYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYDVMK   420
NCWHLDAATR PTFLQLREQL EHIRTHELHL                                   450
```

SEQ ID NO: 35 *Rattus norvegicus* (rat) c-src tyrosine kinase (CSK)
amino acid sequence, isoform X1 (XP_006243225)

```
MSAIQASWPS GTECIAKYNF HGTAEQDLPF CKGDVLTIVA VTKDPNWYKA KNKVGREGII    60
PANYVQKREG VKAGTKLSLM PWFHGKITRE QAERLLYPPE TGLFLVREST NYPGDYTLCV   120
SCEGKVEHYR IMYHASKLSI DEEVYFENLM QLVEHYTTDA DGLCTRLIKP KVMEGTVAAQ   180
DEFYRSGWAL NMKELKLLQT IGKGEFGDVM LGDYRGNKVA VKCIKNDATA QAFLAEASVM   240
TQLRHSNLVQ LLGVIVEEKG GLYIVTEYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYDVMK   420
NCWHLDAATR PTFLQLREQL EHIRTHELHL                                   450
```

SEQ ID NO: 36 *Rattus norvegicus* (rat) c-src tyrosine kinase (CSK)
amino acid sequence, isoform X1 (XP_006243226)

```
MSAIQASWPS GTECIAKYNF HGTAEQDLPF CKGDVLTIVA VTKDPNWYKA KNKVGREGII    60
PANYVQKREG VKAGTKLSLM PWFHGKITRE QAERLLYPPE TGLFLVREST NYPGDYTLCV   120
SCEGKVEHYR IMYHASKLSI DEEVYFENLM QLVEHYTTDA DGLCTRLIKP KVMEGTVAAQ   180
DEFYRSGWAL NMKELKLLQT IGKGEFGDVM LGDYRGNKVA VKCIKNDATA QAFLAEASVM   240
TQLRHSNLVQ LLGVIVEEKG GLYIVTEYMA KGSLVDYLRS RGRSVLGGDC LLKFSLDVCE   300
AMEYLEGNNF VHRDLAARNV LVSEDNVAKV SDFGLTKEAS STQDTGKLPV KWTAPEALRE   360
KKFSTKSDVW SFGILLWEIY SFGRVPYPRI PLKDVVPRVE KGYKMDAPDG CPPAVYDVMK   420
NCWHLDAATR PTFLQLREQL EHIRTHELHL                                   450
```

SEQ ID NO: 37 *Gallus gallus* (chicken) c-src tyrosine kinase (CSK)
cDNA (NM_205425)

```
atgtcaggga tgcaggccgt ttggccatcc ggtacagaat gtatcgccaa gtacaacttc    60
cacggtacgg ccgagcagga cctgccgttc agcaagggag acgtcctcac catcgtcgcc   120
gtcaccaagg accccaactg gtacaaggcg aagaacaaag tgggccggga gggcatcatc   180
cccgctaact acgtgcagaa gagggaagga gtgaaggctg gcatcaagct cagcctcatg   240
ccgtggttcc atgggaagat cacacgggag caggcagaga ggctgctgta cccaccccgag  300
acggggctgt tcctggtgcg ggagagcacc aactaccccg ggactacac cctgtgtgtg   360
agctgtgagg gcaaggtgga gcactaccgc atcatttact cctccagcaa gctgagcatc   420
gacgaggagg tctacttcga gaacctgatg cagcttgtgg agcattacac cacggacgcc   480
gacggcctct gctcgcgcct catcaaaccg aaggtgatgg agggacggt ggcagctcag   540
gatgagttct cccgcagtgg ctgggccctg aacatgaagg acctcaagct gctgcaaatc   600
attggcaaag gggaatttgg agatgtgatg ctggtgatt accgggggaa caaagtcgcc   660
gtcaagtgca ttaaaaatga cgccacacgc aggcttccc tggcagaagc gtccgtgatg   720
acgcagctcc gacacagcaa cctggtgcag ctgctggggg tgatcgtgga ggagaaggac  780
```

TABLE 1-continued

```
ggcctctata ttgtcactga gtatatggcc aagggcagcc tagtagatta cctgcggtcg    840
cgtgggaggt cggtcctagg cggagactgc ctgctcaagt tttccttaga tgtctgtgaa    900
gccatggagt acctggaagc caacaacttc gtccaccggg acctggcggc gaggaatgtg    960
ttggtctcag aggacaacat tgccaaggtc agcgatttcg ggctgacaaa ggaagcgtcg   1020
tccactcagg acacggggaa gctgcctgtg aagtggacgg cacccgaagc acttagagaa   1080
aagaaattct ccaccaaatc ggacgtgtgg agcttcggga tcctcctctg ggaaatctac   1140
tccttcgggc gagtgcctta tccgagaatc ccctgaagg acgtggtgcc ccgggtggag   1200
aagggctata agatggaccc tccagacggc tgcccggcca tcgtctacga ggtgatgaag   1260
aagtgctgga cgctggaccc agggcaccgg ccgtccttcc accagctccg tgaacagcta   1320
gtgcatatca aagagaagga gctctacctg tga                                1353
```

SEQ ID NO: 38 *Gallus gallus* (chicken) c-src tyrosine kinase (CSK)
cDNA (XM_015278794)

```
atgtcaggga tgcaggccgt ttggccatcc ggtacagaat gtatcgccaa gtacaacttc     60
cacggtacgg ccgagcagga cctgccgttc agcaaggggga cgtcctcac catcgtcgcc    120
gtcaccaagg accccaactg gtacaaggcg aagaacaaag tgggccggga gggcatcatc    180
cccgctaact acgtgcagaa gagggaagga gtgaaggctg gcatcaagct cagcctcatg    240
ccgtggttcc atgggaagat cacacgggag caggcagaga ggctgctgta cccacccgag    300
acggggctgt tcctggtgcg ggagagcacc aactaccctg gggactacac cctgtgtgtg    360
agctgtgagg gcaaggtgga gcactaccgc atcatttact cctccagcaa gctgagcatc    420
gatgaggagg tctacttcga aacctgatg cagcttgtgg agcattacac cacggacgcc    480
gacgggctct gcacgcgcct catcaaaccg aaggtgatgg aggggacggt ggcagctcag    540
gacgagttct cccgcagtgg ctgggccctc aacatgaagg acctcaagct gctgcaaatc    600
attggcaaag gggaatttgg agatgtgatg ctgggtgatt accgggggaa caaagtcgtc    660
gtcaagtgca ttaaaaatga cgccacagcg caggcttttcc tggcagaagc atccgtgatg    720
acgcagctcc gacacagcaa cctggtgcag ctgctggggg tgatcgtgga ggagaagagc    780
ggcctctaca ttgtcactga gtatatggcc aagggcagcc tagtagatta cctgcggtcg    840
cgtgggaggt cggtcctagg cgcagactgc ctgctcaagt tttccttaga tgtctgtgaa    900
gccatggagt acctggaagc caacaacttc gtccaccggg acctggcggc gaggaatgtg    960
ttggtctcag aggacaacat tgccaaggtc agcgatttcg ggctgacaaa ggaagcgtcg   1020
tccactcagg acacggggaa gctgcctgtg aagtggacgg cacccgaagc acttagagaa   1080
aagaaattct ccaccaaatc ggacgtgtgg agcttcggga tcctcctctg ggaaatctac   1140
tccttcgggc gagtgcctta tccgagaatc ccctgaagg acgtggtgcc ccgggtggag   1200
aagggctata agatggaccc tccagacggc tgcccggcca tcgtctacga ggtgatgaag   1260
aagtgctgga cgctggaccc agggcaccgg ccgtccttcc accagctccg tgaacagcta   1320
gtgcatatca aagagaagga gctctacctg tga                                1353
```

SEQ ID NO: 39 *Gallus gallus* (chicken) c-src tyrosine kinase (CSK)
amino acid sequence (XP_015134280)

```
MSGMQAVWPS GTECIAKYNF HGTAEQDLPF SKGDVLTIVA VTKDPNWYKA KNKVGREGII     60
PANYVQKREG VKAGIKLSLM PWFHGKITRE QAERLLYPPE TGLFLVREST NYPGDYTLCV    120
SCEGKVEHYR IIYSSSKLSI DEEVYFENLM QLVEHYTTDA DGLCTRLIKP KVMEGTVAAQ    180
DEFSRSGWAL NMKDLKLLQI IGKGEFGDVM LGDYRGNKVA VKCIKNDATA QAFLAEASVM    240
TQLRHSNLVQ LLGVIVEEKS GLYIVTEYMA KGSLVDYLRS RGRSVLGADC LLKFSLDVCE    300
AMEYLEANNF VHRDLAARNV LVSEDNIAKV SDFGLTKEAS STQDTGKLPV KWTAPEALRE    360
KKFSTKSDVW SFGILLWEIY SFGRVPYPRI PLKDVVPRVE KGYKMDPPDG CPAIVYEVMK    420
KCWTLDPGHR PSFHQLREQL VHIKEKELYL                                    450
```

SEQ ID NO: 40 *Gallus gallus* (chicken) c-src tyrosine kinase (CSK)
amino acid sequence (NP_990756)

```
MSGMQAVWPS GTECIAKYNF HGTAEQDLPF SKGDVLTIVA VTKDPNWYKA KNKVGREGII     60
PANYVQKREG VKAGIKLSLM PWFHGKITRE QAERLLYPPE TGLFLVREST NYPGDYTLCV    120
SCEGKVEHYR IIYSSSKLSI DEEVYFENLM QLVEHYTTDA DGLCSRLIKP KVMEGTVAAQ    180
DEFSRSGWAL NMKDLKLLQI IGKGEFGDVM LGDYRGNKVA VKCIKNDATA QAFLAEASVM    240
TQLRHSNLVQ LLGVIVEEKS GLYIVTEYMA KGSLVDYLRS RGRSVLGADC LLKFSLDVCE    300
AMEYLEANNF VHRDLAARNV LVSEDNIAKV SDFGLTKEAS STQDTGKLPV KWTAPEALRE    360
KKFSTKSDVW SFGILLWEIY SFGRVPYPRI PLKDVVPRVE KGYKMDPPDG CPAIVYEVMK    420
KCWTLDPGHR PSFHQLREQL VHIKEKELYL                                    450
```

SEQ ID NO: 41 *Xenopus tropicalis* (frog) c-src tyrosine kinase (CSK)
cDNA (NM_001142143)

```
atgtcagtgg tgcaggcccc ttggcaagct ggcacagaat gcattgctaa ctatgacttc     60
cagggtaaag ctgagcagga cctgcatttt agtaaaggtg aagtgctgac cattgtggct    120
gtgacaaagg atccaaattg gtacaaggca aaaaacaaag tagggagagt gggattcatc    180
cctgcaaact atgtccaaaa agagagaagga gtgaaatctg gaaccaaact cagccttatg    240
ccgtggtttc atggcaagat aacccgagag caggctgagc gtctcttgta tccacctgaa    300
acgggcttat tccttgtacg ggagagtaca aactaccctg gagattatac tctgtgtgta    360
agctgtgaag ggaaagtgga gcattaccgc attatctatt cttctggcaa gctgagcatt    420
gatgaagagg aatactttga aaatctcatg cagctggtgg agcactatac caatgatgca    480
gatggcctgt gcacaaattt gatgaagccc aaattggtgg agggaactgt agctgcccag    540
gatgaattct cccggagtgg atctgggcctc aagatgaaag atctcaaact gctgcacacc    600
attggcaagg gggaatttgg agatgtcatg cttggtgaac atcaaggagt gaaagtagct    660
gtgaaatgta tcaagaacga tgccacggca caagcatttg tagcagaagc tatggtgatg    720
acgcaattgc aacataacaa tcttgtgcag ctacttggag tgattgttga agataaaagt    780
ggtttgtttα tcgtcacaga atttatgca aagggaagcc tagtggatta tttgaggtct    840
cgggggaaggt cagtgctagg tgcgaatgt ctactaaagt tctcactgga tgtatcagaa    900
```

TABLE 1-continued

| | | | | | | |
|---|---|---|---|---|---|---|
| ggtatggcat | atcttgagag | taataacttt | gtgcacagag | atctagcggc | acgcaatgtg | 960 |
| ttggtatcag | aagaaaatat | tgctaaggtc | agtgactttg | gactcaccaa | ggaagcatcc | 1020 |
| gccatacagg | acacaagcaa | actgcctgtt | aagtggacag | caccagaagc | gttgcgggat | 1080 |
| aagctatttt | caaccaagtc | tgatgtttgg | agctttggaa | ttctgttatg | ggagatctat | 1140 |
| tcctttgggc | gagtgcctta | tccacgcatt | gcccttaaag | atgtggtacc | aaaggtggag | 1200 |
| aatgggtata | aaatggacgc | acccgatgga | tgtcctcctg | ttgtatatga | tttgatgaag | 1260 |
| cagtgttggc | atctggaccc | aaaacagcga | cccacttta | ggaatctgcg | agaacagcta | 1320 |
| gagcatatca | aagcgaagga | actgtttcac | tga | | | 1353 |

SEQ ID NO: 42 *Xenopus tropicalis* (frog) c-src tyrosine kinase (CSK)
amino acid sequence (NP_001135615)

| | | | | | | |
|---|---|---|---|---|---|---|
| MSVVQAPWQA | GTECIANYDF | QGKAEQDLHF | SKGEVLTIVA | VTKDPNWYKA | KNKVGRVGFI | 60 |
| PANYVQKREG | VKSGTKLSLM | PWFHGKITRE | QAERLLYPPE | TGLFLVREST | NYPGDYTLCV | 120 |
| SCEGKVEHYR | IIYSSGKLSI | DEEEYFENLM | QLVEHYTNDA | DGLCTNLMKP | KLVEGTVAAQ | 180 |
| DEFSRSGWAL | KMRDLKLLHT | IGKGEFGDVM | LGEHQGVKVA | VKCIKNDATA | QAFVAEAMVM | 240 |
| TQLQHNNLVQ | LLGVIVEDKS | GLFIVTEFMA | KGSLVDYLRS | RGRSVLGGEC | LLKFSLDVSE | 300 |
| GMAYLESNNF | VHRDLAARNV | LVSEENIAKV | SDFGLTKEAS | AIQDTSKLPV | KWTAPEALRD | 360 |
| KLFSTKSDVW | SFGILLWEIY | SFGRVPYPRI | ALKDVVPKVE | NGYKMDAPDG | CPPVVYDLMK | 420 |
| QCWHLDPKQR | PTFRNLREQL | EHIKAKELFH | | | | 450 |

Included in Table 1 are RNA nucleic acid molecules (e.g., thymines replaced with uridines), nucleic acid molecules encoding orthologs of the encoded proteins, as well as DNA or RNA nucleic acid sequences comprising a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with the nucleic acid sequence of any SEQ ID NO listed in Table 1, or a portion thereof. Such nucleic acid molecules can have a function of the full-length nucleic acid as described further herein.

Included in Table 1 are orthologs of the proteins, as well as polypeptide molecules comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with an amino acid sequence of any SEQ ID NO listed in Table 1, or a portion thereof. Such polypeptides can have a function of the full-length polypeptide as described further herein.

Included in Table 1 are CSK null mutations, missense mutations, nonsense mutations, frameshift mutations, insertion mutation, deletion mutations, and rearrangement mutations.

Human PAK2 nucleic acid (NM_002577) and amino acid (NP_002568) sequences are publicly available on the GenBank database maintained by the U.S. National Center for Biotechnology Information. Nucleic acid and polypeptide sequences of PAK2 orthologs in species other than humans are also well known and include, for example, mouse PAK2 (NM_177326, NP_796300), chimpanzee PAK2 (XM_016940213, XP_016795702), monkey PAK2 (XP_014988061, NP_001252864), dog PAK2 (XM_844339, XP_849432), cow PAK2 (NM_001206727, NP_001193656), rat PAK2 (XM_003751066, XP_008767000), and chicken PAK2 (XM_003751066, XP_008767000).

Representative sequences of PAK2 orthologs are presented below in Table 2. Anti-PAK2 agents, including antibodies, nucleic acids, and the like are well-known in the art. It is to be noted that the term can further be used to refer to any combination of features described herein regarding PAK2 molecules. For example, any combination of sequence composition, percentage identify, sequence length, domain structure, functional activity, etc. can be used to describe an PAK2 molecule of the present invention.

Human CRK nucleic acid (NM_005206, NM_016823) and amino acid (NP_058431, NP_005197) sequences are publicly available on the GenBank database maintained by the U.S. National Center for Biotechnology Information. Nucleic acid and polypeptide sequences of CRK orthologs in species other than humans are also well known and include, for example, mouse CRK (NM_001277219, NP_001264148), chimpanzee CRK (XM_016931122, XP_016786611), monkey CRK (XM_002808109, XP_002808155), dog CRK (XM_003435202, XP_003435250), cow CRK (NM_001192334, NP_001179263), rat CRK (NM_019302, NP_062175), and chicken CRK (NM_001007846; NP_001007847).

Representative sequences of CRK orthologs are presented below in Table 2. Anti-CRK agents, including antibodies, nucleic acids, and the like are well-known in the art. It is to be noted that the term can further be used to refer to any combination of features described herein regarding CRK molecules. For example, any combination of sequence composition, percentage identify, sequence length, domain structure, functional activity, etc. can be used to describe an CRK molecule of the present invention.

TABLE 2

SEQ ID NO: 43 *Homo sapiens* p21 (RAC1) activated kinase 2 (PAK2)
cDNA, transcript variant 1 (NM_002577)

| | | | | | | |
|---|---|---|---|---|---|---|
| atgtctgata | acggagaact | ggaagataag | cctccagcac | ctcctgtgcg | aatgagcagc | 60 |
| accatcttta | gcactggagg | caaagaccct | ttgtcagcca | atcacagttt | gaaacctttg | 120 |
| ccctctgttc | cagaagagaa | aaagcccagg | cataaaatca | tctccatatt | ctcaggcaca | 180 |
| gagaaaggaa | gtaaaaagaa | agaaaaggaa | cggccagaaa | tttctcctcc | atctgatttt | 240 |
| gagcacacca | tccatgttgg | ctttgatgct | gttactggag | aattcactgg | catgccagaa | 300 |
| cagtgggctc | gattactaca | gacctccaat | atcaccaaac | tagagcaaaa | gaagaatcct | 360 |
| caggctgtgc | tggatgtcct | aaagttctac | gactccaaca | cagtgaagca | gaaatatctg | 420 |

TABLE 2-continued

```
agctttactc ctcctgagaa agatggcttt ccttctggaa caccagcact gaatgccaag     480
ggaacagaag caccccgcagt agtgacagag gaggaggatg atgatgaaga gactgctcct    540
cccgttattg ccccgcgacc ggatcatacg aaatcaattt acacacggtc tgtaattgac    600
cctgttcctg caccagttgg tgattcacat gttgatggtg ctgccaagtc tttagacaaa    660
cagaaaaaga agactaagat gacagatgaa gagattatgg agaaattaag aactatcgtg    720
agcataggtg acccctaagaa aaaatataca agatatgaaa aaattggaca aggggcttct    780
ggtacagttt tcactgctac tgacgttgca ctgggacagg aggttgctat caaacaaatt    840
aatttacaga aacagccaaa gaaggaactg atcattaacg agattctggt gatgaaagaa    900
ttgaaaaatc ccaacatcgt taacttttttg gacagttacc tggtaggaga tgaattgttt    960
gtggtcatgg aataccttgc tgggggggtca ctcactgatg tggtaacaga aacgtgcatg   1020
gatgaagcac agattgctgc tgtatgcaga gagtgtttac aggcattgga gtttttacat   1080
gctaatcaag tgatccacag agacatcaaa agtgacaatg tacttttggg aatggaagga   1140
tctgttaagc tcactgactt tggtttctgt gcccagatca cccctgagca gagcaaacgc   1200
agtaccatgg tcggaacgcc atactggatg gcaccagagg tggttacacg gaaagcttat   1260
ggccctaaag tcgacatatg gtctctgggt atcatggcta ttgagatggt agaaggagag   1320
cctccatacc tcaatgaaaa tcccttgagg gccttgtacc taatagcaac taatggaacc   1380
ccagaacttc agaatccaga gaaactttcc ccaatatttc gggattctt aaatcgatgt    1440
ttggaaatgg atgtggaaaa aagggggttca gccaagaat tattacagca tccttttcctg   1500
aaaactggcca aaccgttatc tagcttgaca ccactgatca tggcagctaa agaagcaatg   1560
aagagtaacc gttaa                                                    1575
```

SEQ ID NO: 44 *Homo sapiens* p21 (RAC1) activated kinase 2 (PAK2)
cDNA, transcript variant X1 (XM_011512870)

```
atgtctgata acggagaact ggaagataag cctccagcac ctcctgtgcg aatgagcagc     60
accatcttta gcactggagg caaagaccct ttgtcagcca atcacagttt gaaacctttg    120
ccctctgttc cagaagagaa aaagcccagg cataaaatca tctccatatt ctcaggcaca    180
gagaaggaa gtaaaaagaa agaaaaggaa cggccagaaa tttctcctcc atctgatttt    240
gagcacacca tccatgttgg ctttgatgct gttactggag aattcactgg catgccagaa    300
cagtgggctc gattactaca gacctccaat atcaccaaac tagagcaaaa gaagaatcct    360
caggctgtgc tggatgtcct aaagttctac gactccaaca cagtgaagca gaaatatctg    420
agctttactc ctcctgagaa agatggcttt ccttctggaa caccagcact gaatgccaag    480
ggaacagaag caccccgcagt agtgacagag gaggaggatg atgatgaaga gactgctcct    540
cccgttattg ccccgcgacc ggatcatacg aaatcaattt acacacggtc tgtaattgac    600
cctgttcctg caccagttgg tgattcacat gttgatggtg ctgccaagtc tttagacaaa    660
cagaaaaaga agactaagat gacagatgaa gagattatgg agaaattaag aactatcgtg    720
agcataggtg acccctaagaa aaaatataca agatatgaaa aaattggaca aggggcttct    780
ggtacagttt tcactgctac tgacgttgca ctgggacagg aggttgctat caaacaaatt    840
aatttacaga aacagccaaa gaaggaactg atcattaacg agattctggt gatgaaagaa    900
ttgaaaaatc ccaacatcgt taacttttttg gacagttacc tggtaggaga tgaattgttt    960
gtggtcatgg aataccttgc tgggggggtca ctcactgatg tggtaacaga aacgtgcatg   1020
gatgaagcac agattgctgc tgtatgcaga gagtgtttac aggcattgga gtttttacat   1080
gctaatcaag tgatccacag agacatcaaa agtgacaatg tacttttggg aatggaagga   1140
tctgttaagc tcactgactt tggtttctgt gcccagatca cccctgagca gagcaaacgc   1200
agtaccatgg tcggaacgcc atactggatg gcaccagagg tggttacacg gaaagcttat   1260
ggccctaaag tcgacatatg gtctctgggt atcatggcta ttgagatggt agaaggagag   1320
cctccatacc tcaatgaaaa tcccttgagg gccttgtacc taatagcaac taatggaacc   1380
ccagaacttc agaatccaga gaaactttcc ccaatatttc gggattctt aaatcgatgt    1440
ttggaaatgg atgtggaaaa aagggggttca gccaagaat tattacagca tccttttcctg   1500
aaaactggcca aaccgttatc tagcttgaca ccactgatca tggcagctaa agaagcaatg   1560
aagagtaacc gttaa                                                    1575
```

SEQ ID NO: 45 *Homo sapiens* p21 (RAC1) activated kinase 2 (PAK2)
cDNA, transcript variant X2 (XM_017006501)

```
atgtctgata acggagaact ggaagataag cctccagcac ctcctgtgcg aatgagcagc     60
accatcttta gcactggagg caaagaccct ttgtcagcca atcacagttt gaaacctttg    120
ccctctgttc cagaagagaa aaagcccagg cataaaatca tctccatatt ctcaggcaca    180
gagaaaggaa gtaaaaagaa agaaaaggaa cggccagaaa tttctcctcc atctgatttt    240
gagcacacca tccatgttgg ctttgatgct gttactggag aattcactgg catgccagaa    300
cagtgggctc gattactaca gacctccaat atcaccaaac tagagcaaaa gaagaatcct    360
caggctgtgc tggatgtcct aaagttctac gactccaaca cagtgaagca gaaatatctg    420
agctttactc ctcctgagaa agatggcttt ccttctggaa caccagcact gaatgccaag    480
ggaacagaag caccccgcagt agtgacagag gaggaggatg atgatgaaga gactgctcct    540
cccgttattg ccccgcgacc ggatcatacg aaatcaattt acacacggtc tgtaattgac    600
cctgttcctg caccagttgg tgattcacat gttgatggtg ctgccaagtc tttagacaaa    660
cagaaaaaga agactaagat gacagatgaa gagattatgg agaaattaag aactatcgtg    720
agcataggtg acccctaagaa aaaatataca agatatgaaa aaattggaca aggggcttct    780
ggtacagttt tcactgctac tgacgttgca ctgggacagg aggttgctat caaacaaatt    840
aatttacaga aacagccaaa gaaggaactg atcattaacg agattctggt gatgaaagaa    900
ttgaaaaatc ccaacatcgt taacttttttg gacagttacc tggtaggaga tgaattgttt    960
gtggtcatgg aataccttgc tgggggggtca ctcactgatg tggtaacaga aacgtgcatg   1020
gatgaagcac agattgctgc tgtatgcaga gagtgtttac aggcattgga gtttttacat   1080
gctaatcaag tgatccacag agacatcaaa agtgacaatg tacttttggg aatggaagga   1140
tctgttaagc tcactgactt tggtttctgt gcccagatca cccctgagca gagcaaacgc   1200
agtaccatgg tcggaacgcc atactggatg gcaccagagg tggttacacg gaaagcttat   1260
ggccctaaag tcgacatatg gtctctgggt atcatggcta ttgagatggt agaaggagag   1320
cctccatacc tcaatgaaaa tcccttgagg gccttgtacc taatagcaac taatggaacc   1380
ccagaacttc agaatccaga gaaactttcc ccaatatttc gggattctt aaatcgatgt    1440
ttggaaatgg atgtggaaaa aagggggttca gccaagaat tattacagca tccttttcctg   1500
```

TABLE 2-continued

```
aaactggcca aaccgttatc tagcttgaca ccactgatca tggcagctaa agaagcaatg    1560
aagagtaacc gttaa                                                    1575
```

SEQ ID NO: 46 *Homo sapiens* p21 (RAC1) activated kinase 2 (PAK2)
amino acid sequence (NP_002568)

```
MSDNGELEDK PPAPPVRMSS TIFSTGGKDP LSANHSLKPL PSVPEEKKPR HKIISIFSGT     60
EKGSKKKEKE RPEISPPSDF EHTIHVGFDA VTGEFTGMPE QWARLLQTSN ITKLEQKKNP    120
QAVLDVLKFY DSNTVKQKYL SFTPPEKDGF PSGTPALNAK GTEAPAVVTE EEDDDEETAP    180
PVIAPRPDHT KSIYTRSVID PVPAPVGDSH VDGAAKSLDK QKKKTKMTDE EIMEKLRTIV    240
SIGDPKKKYT RYEKIGQGAS GTVFTATDVA LGQEVAIKQI NLQKQPKKEL IINEILVMKE    300
LKNPNIVNFL DSYLVGDELF VVMEYLAGGS LTDVVTETCM DEAQIAAVCR ECLQALEFLH    360
ANQVIHRDIK SDNVLLGMEG SVKLTDEGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS AKELLQHPFL KLAKPLSSLT PLIMAAKEAM KSNR                     524
```

SEQ ID NO: 47 *Homo sapiens* p21 (RAC1) activated kinase 2 (PAK2)
amino acid sequence, isoform X1 (XP_011511172)

```
MSDNGELEDK PPAPPVRMSS TIFSTGGKDP LSANHSLKPL PSVPEEKKPR HKIISIFSGT     60
EKGSKKKEKE RPEISPPSDF EHTIHVGFDA VTGEFTGMPE QWARLLQTSN ITKLEQKKNP    120
QAVLDVLKFY DSNTVKQKYL SFTPPEKDGF PSGTPALNAK GTEAPAVVTE EEDDDEETAP    180
PVIAPRPDHT KSIYTRSVID PVPAPVGDSH VDGAAKSLDK QKKKTKMTDE EIMEKLRTIV    240
SIGDPKKKYT RYEKIGQGAS GTVFTATDVA LGQEVAIKQI NLQKQPKKEL IINEILVMKE    300
LKNPNIVNFL DSYLVGDELF VVMEYLAGGS LTDVVTETCM DEAQIAAVCR ECLQALEFLH    360
ANQVIHRDIK SDNVLLGMEG SVKLTDEGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS AKELLQHPFL KLAKPLSSLT PLIMAAKEAM KSNR                     524
```

SEQ ID NO: 48 *Homo sapiens* p21 (RAC1) activated kinase 2 (PAK2)
amino acid sequence, isoform X1 (XP_016861990)

```
MSDNGELEDK PPAPPVRMSS TIFSTGGKDP LSANHSLKPL PSVPEEKKPR HKIISIFSGT     60
EKGSKKKEKE RPEISPPSDF EHTIHVGFDA VTGEFTGMPE QWARLLQTSN ITKLEQKKNP    120
QAVLDVLKFY DSNTVKQKYL SFTPPEKDGF PSGTPALNAK GTEAPAVVTE EEDDDEETAP    180
PVIAPRPDHT KSIYTRSVID PVPAPVGDSH VDGAAKSLDK QKKKTKMTDE EIMEKLRTIV    240
SIGDPKKKYT RYEKIGQGAS GTVFTATDVA LGQEVAIKQI NLQKQPKKEL IINEILVMKE    300
LKNPNIVNFL DSYLVGDELF VVMEYLAGGS LTDVVTETCM DEAQIAAVCR ECLQALEFLH    360
ANQVIHRDIK SDNVLLGMEG SVKLTDEGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS AKELLQHPFL KLAKPLSSLT PLIMAAKEAM KSNR                     524
```

SEQ ID NO: 49 *Pan troglodytes* (chimpanzee) p21 (RAC1) activated
kinase 2 (PAK2) cDNA (XM_016940213)

```
atgtctgata acggagaact ggaagacaag cctccagcac ctcctgtgcg aatgagcagc      60
accatcttta gcactggagg caaagaccct ttgtcagcca atcacagttt gaaacctttg     120
ccctctgttc cagaagagaa aaagcccagg cataaaatca tctccatatt ctcaggcaca     180
gagaaggaa gtaaaagaa agaaaaggaa cggccagaaa tttctcctcc atctgatttt      240
gagcacacca tccatgttgg ctttgatgct gttactggag aattcactgg catgccagaa     300
cagtgggctc gattactaca gacctccaat atcaccaaac tagagcaaaa gaagaatcct     360
caggctgtgc tggatgtcct aaagttctac gactccaaca cagtgaagca gaaatatctg     420
agctttactc ctcctgagaa agatggcttt ccttctggaa caccagcact gaatgccaag     480
ggaacagaag caccccgcagt agtgacagag gaggaggatg atgatgaaga gactgctcct     540
cccgttattg ccccgcgacc ggatcatacg aaatcaattt acacacggtc tgtaattgac     600
cctgttcctg caccagttgg tgattcacat gttgatggtg ctgccaagtc tttagacaaa     660
cagaaaaaga agactaagat gacagatgaa gagattatgg agaaattaag aactatcgtg     720
agcataggtg accctaagaa aaaatataca agatatgaaa aaattggaca aggggcttct     780
ggtacagttt tcactgctac tgacgttgca ttgggacagg aggttgctat caaacaaatt     840
aatttacaga aacagccaaa gaaggaactg atcattaacg agattctggt gatgaaagaa     900
ttgaaaaatc ccaacatcgt taacttttg gacagttacc tggtaggaga tgaattgttt     960
gtggtcatgg aataccttgc tgggggtca ctcactgatg tggtaacaga aacctgcatg    1020
gatgaagcac agattgctgc tgtatgcaga gagtgtttac aggcattgga gttttacat    1080
gctaatcaag tgatccacag agacatcaaa agtgacaatg tactttttggg aatggaagga    1140
tcggttaaac tcactgactt tggttttctgt gcccagatca cccctgagca gagcaaacgc    1200
agtaccatgg tcggaacgcc atactggatg gcaccagagg tggttacacg gaaagcgtat    1260
ggccctaagg tcgacatatg gtctctgggt atcatgccta ttgagatgat agaaggagag    1320
cctccatacc tcaatgaaaa tcccttgagg gccttgtacc taatagcaac taatggaacc    1380
ccagaacttc agaatccaga gaacttttcc caatatttc gggatttctt aaatcgatgt    1440
ttggaaatgg atgtggaaaa aaggggttca gccaaagaat tattacagca tccttttcctg    1500
aaactggcca aaccgttatc tagcttgaca ccactgatca tggcagctaa agaagcaatg    1560
aagagtaacc gttaa                                                    1575
```

SEQ ID NO: 50 *Pan troglodytes* (chimpanzee) p21 (RAC1) activated
kinase 2 (PAK2) amino acid sequence (XP_016795702)

```
MSDNGELEDK PPAPPVRMSS TIFSTGGKDP LSANHSLKPL PSVPEEKKPR HKIISIFSGT     60
EKGSKKKEKE RPEISPPSDF EHTIHVGFDA VTGEFTGMPE QWARLLQTSN ITKLEQKKNP    120
QAVLDVLKFY DSNTVKQKYL SFTPPEKDGF PSGTPALNAK GTEAPAVVTE EEDDDEETAP    180
PVIAPRPDHT KSIYTRSVID PVPAPVGDSH VDGAAKSLDK QKKKTKMTDE EIMEKLRTIV    240
```

TABLE 2-continued

```
SIGDPKKKYT RYEKIGQGAS GTVFTATDVA LGQEVAIKQI NLQKQPKKEL IINEILVMKE    300
LKNPNIVNFL DSYLVGDELF VVMEYLAGGS LTDVVTETCM DEAQIAAVCR ECLQALEFLH    360
ANQVIHRDIK SDNVLLGMEG SVKLTDFGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS AKELLQHPFL KLAKPLSSLT PLIMAAKEAM KSNR                     524
```

SEQ ID NO: 51 *Macaca mulatta* (*Rhesus macaque*) p21 (RAC1) activated kinase 2 (PAK2) cDNA (NM_001265935)

```
atgtctgata acggagaact ggaagacaag cccccagcac ctcctgtgcg aatgagcagc     60
accatcttta gcactggagg caaagacccc ttgtcagcca atcacagttt gaaacctttg    120
ccctctgttc cggaggagaa gaagcccagg cacaaaatca tctccatatt ctcaggcaca    180
gagaaaggaa gtaaaaagaa agaaaaggaa cggccagaaa tttctcctcc atctgatttt    240
gaacacacca tccatgttgg cttttgatgct gttactggag aattcactgg catgccagaa    300
cagtgggctc gattactaca gacctccaac atcaccaaac tagagcaaaa gaagaatcct    360
caggctgtgc tggatgtcct caagttctac gactccaaca cagtgaagca gaagtatctg    420
agctttactc ctccggagaa agatggcttc ccttctggaa caccagcact gaacgccaag    480
ggaacagaaa caccccgcagt agtgacagag gaagatgatg atgatgaaga gactgctcct    540
cctgttattg ccccacgacc agatcatacg aaatcaattt acacacggtc tgtaattgac    600
cccgttcctg caccagttgg tgattcaagt gttgatggtg gtgccaagtc ttcagacaaa    660
cagaaaaaga agactaaaat gacagatgaa gaaattatgg agaaattaag aactattgtg    720
agcataggtg accctaagaa aaaatataca agatatgaaa aaattggaca aggggcttct    780
ggtacagttt tcactgctac tgacgttgca ttgggacagg aggttgctat caaacagatt    840
aatttacaga acagccaaa gaaggaattg atcattaatg agattctggt gatgaaagaa    900
ttaaaaaatc ccaacatagt taacttcttg gacagttacc tggtaggaga tgaattgttt    960
gtggtcatgg aataccttgc tggtggatcg ctcactgatg tggtaacaga aacctgcatg   1020
gatgaagcac agattgctgc tgtatgcaga gagtgcttgc aggcgttgga gtttttacat   1080
gctaatcaag tgatccacag agacatcaaa agcgacaatg tccttttggg aatggaagga   1140
tcggttaagc tcactgactt tggtttctgt gcccagatca cccccgagca gagcaaacgc   1200
agtaccatgg tcggaacccc atactggatg gcaccagagg tggttacacg gaaagcttat   1260
ggcccccaaag tcgacatatg gtctctgggg atcatggcta ttgagatggt agaaggagag   1320
cctccatacc tcaatgaaaa tcccttgagg gccttgtacc taatagcaac taatggaacc   1380
ccagagcttc agaatccaga gaaactttcc ccaatatttc gagatttctt aaatcgatgt   1440
ttggaaatgg atgtggaaaa aaggggttca gccaaagaat tattacagca tcctttcttg   1500
aaactggcca aaccattatc tagcttgaca ccactgatca tggcagctaa agaagcgatg   1560
aagagtaacc gttaa                                                    1575
```

SEQ ID NO: 52 *Macaca mulatta* (*Rhesus macaque*) p21 (RAC1) activated kinase 2 (PAK2) cDNA, transcript variant X1 (XM_015132575)

```
atgtctgata acggagaact ggaagacaag cccccagcac ctcctgtgcg aatgagcagc     60
accatcttta gcactggagg caaagacccc ttgtcagcca atcacagttt gaaacctttg    120
ccctctgttc cggaggagaa gaagcccagg cacaaaatca tctccatatt ctcaggcaca    180
gagaaaggaa gtaaaaagaa agaaaaggaa cggccagaaa tttctcctcc atctgatttt    240
gaacacacca tccatgttgg cttttgatgct gttactggag aattcactgg catgccagaa    300
cagtgggctc gattactaca gacctccaac atcaccaaac tagagcaaaa gaagaatcct    360
caggctgtgc tggatgtcct caagttctac gactccaaca cagtgaagca gaagtatctg    420
agctttactc ctccggagaa agatggcttc ccttctggaa caccagcact gaacgccaag    480
ggaacagaaa caccccgcagt agtgacagag gaagatgatg atgatgaaga gactgctcct    540
cctgttattg ccccacgacc agatcatacg aaatcaattt acacacggtc tgtaattgac    600
cccgttcctg caccagttgg tgattcaagt gttgatggtg gtgccaagtc ttcagacaaa    660
cagaaaaaga agactaaaat gacagatgaa gaaattatgg agaaattaag aactattgtg    720
agcataggtg accctaagaa aaaatataca agatatgaaa aaattggaca aggggcttct    780
ggtacagttt tcactgctac tgacgttgca ttgggacagg aggttgctat caaacagatt    840
aatttacaga acagccaaa gaaggaattg atcattaatg agattctggt gatgaaagaa    900
ttaaaaaatc ccaacatagt taacttcttg gacagttacc tggtaggaga tgaattgttt    960
gtggtcatgg aataccttgc tggtggatcg ctcactgatg tggtaacaga aacctgcatg   1020
gatgaagcac agattgctgc tgtatgcaga gagtgtctgc aggcgttgga gtttttacat   1080
gctaatcaag tgatccacag agacatcaaa agcgacaatg tccttttggg aatggaagga   1140
tcggttaagc tcactgactt tggtttctgt gcccagatca cccccgagca gagcaaacgc   1200
agtaccatgg tcggaacccc atactggatg gcaccagagg tggttacacg gaaagcttat   1260
ggcccccaaag tcgacatatg gtctctgggg atcatggcta ttgagatggt agaaggagag   1320
cctccatacc tcaatgaaaa tcccttgagg gccttgtacc taatagcaac taatggaacc   1380
ccagagcttc agaatccaga gaaactttcc ccaatatttc gagatttctt aaatcgatgt   1440
ttggaaatgg atgtggaaaa aaggggttca gccaaagaat tattacagca tcctttcttg   1500
aaactggcca aaccattatc tagcttgaca ccactgatca tggcagctaa agaagcgatg   1560
aagagtaacc gttaa                                                    1575
```

SEQ ID NO: 53 *Macaca mulatta* (*Rhesus macaque*) p21 (RAC1) activated kinase 2 (PAK2) amino acid sequence (XP_014988061)

```
MSDNGELEDK PPAPPVRMSS TIFSTGGKDP LSANHSLKPL PSVPEEKKPR HKIISIFSGT     60
EKGSKKKEKE RPEISPPSDF EHTIHVGFDA VTGEFTGMPE QWARLLQTSN ITKLEQKKNP    120
QAVLDVLKFY DSNTVKQKYL SFTPPEKDGF PSGTPALNAK GTETPAVVTE EDDDDEETAP    180
PVIAPRPDHT KSIYTRSVID PVPAPVGDSS VDGGAKSSDK QKKKTKMTDE EIMEKLRTIV    240
SIGDPKKKYT RYEKIGQGAS GTVFTATDVA LGQEVAIKQI NLQKQPKKEL IINEILVMKE    300
LKNPNIVNFL DSYLVGDELF VVMEYLAGGS LTDVVTETCM DEAQIAAVCR ECLQALEFLH    360
ANQVIHRDIK SDNVLLGMEG SVKLTDFGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS AKELLQHPFL KLAKPLSSLT PLIMAAKEAM KSNR                     524
```

TABLE 2-continued

SEQ ID NO: 54 *Macaca mulatta* (Rhesus macaque) p21 (RAC1) activated
kinase 2 (PAK2) amino acid sequence, transcript variant X1
(NP_001252864)

```
MSDNGELEDK PPAPPVRMSS TIFSTGGKDP LSANHSLKPL PSVPEEKKPR HKIISIFSGT    60
EKGSKKKEKE RPEISPPSDF EHTIHVGFDA VTGEFTGMPE QWARLLQTSN ITKLEQKKNP   120
QAVLDVLKFY DSNTVKQKYL SFTPPEKDGF PSGTPALNAK GTETPAVVTE EDDDDEETAP   180
PVIAPRPDHT KSIYTRSVID PVPAPVGDSS VDGGAKSSDK QKKKTKMTDE EIMEKLRTIV   240
SIGDPKKKYT RYEKIGQGAS GTVFTATDVA LGQEVAIKQI NLQKQPKKEL IINEILVMKE   300
LKNPNIVNFL DSYLVGDELF VVMEYLAGGS LTDVVTETCM DEAQIAAVCR ECLQALEFLH   360
ANQVIHRDIK SDNVLLGMEG SVKLTDEGFC AQITPEQSKR STMVGTPYWM APEVVTRKAY   420
GPKVDIWSLG IMAIEMVEGE PPYLNENPLR ALYLIATNGT PELQNPEKLS PIFRDFLNRC   480
LEMDVEKRGS AKELLQHPFL KLAKPLSSLT PLIMAAKEAM KSNR                    524
```

SEQ ID NO: 55 *Canis lupus familiaris* (dog) p21 (RAC1) activated
kinase 2 (PAK2) cDNA (XM_844339)

```
atgtccgata acggagaact ggaagacaag cctccagcac ctcctgtgcg aatgagcagt    60
accatttta gcactggagg caaagatcct ttgtcagcca atcacagttt gaaacctttg   120
ccctccgttc cagaggaaaa aaagcccagg aataaaatca tctctatatt ctccggcaca   180
gagaaaggaa gtaagaagaa agaaaaggaa cggccagaaa tttctcctcc atctgatttt   240
gagcatacca tccatgttgg ctttgatgcg gttacgggag aatttactgg catgccagaa   300
cagtgggctc gattattaca gacctccaat atcaccaaac tagagcaaaa gaagaatcct   360
caggctgtgc tggatgtctt aaagttctat gactccaaca cagtgaagca gaaatacctg   420
agctttactc ctactgagaa agatggcttc ccttctggaa cacccacact gagtgccaag   480
ggttcagaaa cagcagcagt agtagcagag gaagatgatg atgatgaaga ggctgctcct   540
cctgttattg ccccacgacc ggatcataca aaatcaattt atacacgtc tgtaattgac   600
cctattcctg caccagttgg tgattctaat gttgatagcg gtgccaagtc ttctgacaaa   660
cagaaaaaga gaccaaaat gacagatgaa gagattatgg aaaaattaag aactattgtg   720
agcataggtg accctaagaa aaaatacaca agatacgaaa aaattgggca aggggcttct   780
ggtacagttt tcactgctac tgatgtggca ttgggacagg aggttgctat caaacagatt   840
aatttacaga aacagccaaa gaaggaatta atcattaatg agattctggt gatgaaagaa   900
ttaaagaatc ccaacatagt taacttcttg gacagttacc tgtgggaga cgaattgttt   960
gtagtaatgg agtaccttgc cgggggatca cttactgatg ttgtaacaga aacctgcatg  1020
gatgaagcac agattgctgc tgtatgcaga gagtgtttac aggcattgga gtttttacat  1080
gctaatcaag tgatccacag agacatcaaa agtgacaacg tgcttttggg gatggaagga  1140
tcagttaaac ttactgactt tggggtctgt gcccagatca ccctgagca gagcaagaga  1200
agtaccatgg ttggaaccgc atactggatg gcaccagagg tggttacacg aaaagcttat  1260
ggccctaaag tggacatatg gtctctgggt atcatggcta ttgagatgat agaaggagag  1320
ccgccatacc tcaatgaaaa tcccttgagg gccttgtacc tgatagcaac taatggaact  1380
ccagaacttc agaatccaga gaagcttcc ccaatatttc gggatttctt aaaccgttgt  1440
ttggagatgg atgtggagaa aaggggttcg gccaaagaat tattacagca tccctcctg  1500
aaactggcca aaccttgtc cagcttgaca ccactgatca tggcagctaa gaagcaatg  1560
aagagtaacc gttag                                                  1575
```

SEQ ID NO: 56 *Canis lupus familiaris* (dog) p21 (RAC1) activated
kinase 2 (PAK2) amino acid sequence (XP_849432)

```
MSDNGELEDK PPAPPVRMSS TIFSTGGKDP LSANHSLKPL PSVPEEKKPR NKIISIFSGT    60
EKGSKKKEKE RPEISPPSDF EHTIHVGFDA VTGEFTGMPE QWARLLQTSN ITKLEQKKNP   120
QAVLDVLKFY DSNTVKQKYL SFTPTEKDGF PSGTPTLSAK GSETAAVVAE EDDDDEEAAP   180
PVIAPRPDHT KSIYTRSVID PIPAPVGDSN VDSGAKSSDK QKKKTKMTDE EIMEKLRTIV   240
SIGDPKKKYT RYEKIGQGAS GTVETATDVA LGQEVAIKQI NLQKQPKKEL IINEILVMKE   300
LKNPNIVNFL DSYLMGDELF VVMEYLAGGS LTDVVTETCM DEAQIAAVCR ECLQALEFLH   360
ANQVIHRDIK SDNVLLGMEG SVKLTDEGFC AQITPEQSKR STMVGTPYWM APEVVTRKAY   420
GPKVDIWSLG IMAIEMIEGE PPYLNENPLR ALYLIATNGT PELQNPEKLS PIFRDFLNRC   480
LEMDVEKRGS AKELLQHPFL KLAKPLSSLT PLIMAAKEAM KSNR                    524
```

SEQ ID NO: 57 *Bos taurus* (cow) p21 (RAC1) activated kinase 2 (PAK2)
cDNA (NM_001206727)

```
atgtctgata acggagaact ggaagacaag cctccggcgc cccagtgcg aatgagcagt    60
actatttta gcactggagg caaagaccct ttatcagcca atcacagttt gaaacctttg   120
ccttccgttc cagaggaaaa aaagcccagg aataaaatca tctctatatt ttcaagcaca   180
gagaaaggaa gtaagaagaa agagaaggaa aggccagaaa tttctcctcc gtctgatttt   240
gagcatacca tccatgttgg ctttgatgct gttactggag aattcactgg catgccagaa   300
cagtgggctc gattactgca gacctccaat atcaccaaac tagagcaaaa gaagaatcct   360
caggcagtgc tggacgtctt gaagttctat gactctaata cagtgaagca gaaatatctg   420
agctttactc ctcctgagaa agatggcttc ccttctggaa caccagcact gaataccaag   480
ggatcggaaa catcagcagt agtaacagag gaagatgacg atgatgaaga ggctcttcct   540
cctgttattg ctcccacgacc agatcataca aaatcaattt atacacgatc tgtaattgat   600
cctattcctg caccagttgg tgattctaat gttgatggtg gtgccaagac ttcagacaaa   660
cagaaaaaga aggccaaaat gacagatgaa gagattatgg agaaattaag aactattgta   720
agcataggtg accctaagaa aaaatacaca agatatgaaa aaattgggca aggggcttct   780
ggcacagttt tcactgctac agatgtggca ttgggacaag aggttgctat taagcagatt   840
aatttacaga aacagccaaa gaaggaattg atcattaatg agattctggt gatgaaagaa   900
ttaaagaatc ccaacatagt taatttcttg gacagttacc tgtgggaga tgaattgttt   960
gtggtcatgg agtaccttgc cggaggatcc cttactgatg ttgtcacaga gacatgcatg  1020
gatgaagccc agatagctgc tgtgtgcaga gagtgtttac aggcattgga gtttttacat  1080
```

TABLE 2-continued

```
gctaatcaag tgatccacag agacatcaaa agtgacaatg tgcttttggg catggaagga    1140
tctgttaaac ttactgactt tggtttctgt gcccagatca cccctgagca gagtaagcgg    1200
agtaccatgg ttggaacgcc atactggatg gcaccagagg tggttacacg gaaagcttat    1260
ggcccaaag  tagacatctg gtctctgggt atcatgcaca ttgaaatgat agaaggagag    1320
cctccatacc tcaatgaaaa tcctttgagg gccttgtacc tgatagcaac taatggaacc    1380
ccagaacttc agaatccaga gaagcttcc  ccaatatttc gggatttctt aaatcgatgt    1440
ttggagatgg atgtggagaa aaggggttca gccagagaat tgttacagca tcccttcctg    1500
aaactggcca agccgttatc cagcttgaca ccactgatta tggcagctaa agaagcaatg    1560
aagagtaacc gttaa                                                     1575
```

SEQ ID NO: 58 Bos taurus (cow) p21 (RAC1) activated kinase 2 (PAK2)
amino acid sequence (NP_001193656)

```
MSDNGELEDK PPAPPVRMSS TIFSTGGKDP LSANHSLKPL PSVPEEKKPR NKIISIFSST     60
EKGSKKKEKE RPEISPPSDF EHTIHVGFDA VTGEFTGMPE QWARLLQTSN ITKLEQKKNP    120
QAVLDVLKFY DSNTVKQKYL SFTPPEKDGF PSGTPALNTK GSETSAVVTE EDDDDEEALP    180
PVIAPRPDHT KSIYTRSVID PIPAPVGDSN VDGGAKTSDK QKKKAKMTDE EIMEKLRTIV    240
SIGDPKKKYT RYEKIGQGAS GTVFTATDVA LGQEVAIKQI NLQKQPKKEL IINEILVMKE    300
LKNPNIVNFL DSYLVGDELF VVMEYLAGGS LTDVVTETCM DEAQIAAVCR ECLQALEFLH    360
ANQVIHRDIK SDNVLLGMEG SVKLTDEGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS ARELLQHPFL KLAKPLSSLT PLIMAAKEAM KSNR                     524
```

SEQ ID NO: 59 Mus musculus p21 (RAC1) activated kinase 2 (PAK2)
cDNA (NM_177326)

```
atgtctgata acggagagct agaagacaag cccccagcac ctccagttcg gatgagcagt     60
accatttta  gcaccggagg aaaagatcct ttatcagcca atcacagttt gaaacctttg    120
ccttctgttc cagaggaaaa aaacccagg  aacaaaatca tctccatatt ctctggcaca    180
gaaaaggaa  gtaaaagaa  agaaaaagaa cggccagaga tttctccccc atctgatttt    240
gagcacacca tccatgttgg ctttgatgct gttacgggag agttcactgg catgccagaa    300
cagtgggcgc ggctgttgca gacctccaac attaccaaac tcgagcagaa gaagaaccct    360
caggcagtgc tggatgtctt gaagttctac gactccaaca ctgtgaaaca gaagtacctg    420
agtttcactc ctcctgagaa agatggcttc ccttctggaa caccagcact gaacaccaag    480
gggtcagaga catcagctgt agtgacagag gaagatgatg atgatgaaga cgctgctcct    540
cccgtcattg cccctcggcc agatcataca aaatcaattt acacacggtc tgtcatcgac    600
cccattcctg ctccagttgg tgattctaat gttgacagtg gtgccaagtc ttcagacaaa    660
cagaaaaaga aagccaagat gaccgatgaa gagattatgg agaaattaag aactattgtg    720
agcataggg  acccaaagaa aaaatacaca agatatgaaa aaattgggca aggggcttct    780
ggaacagttt ttactgccac tgatgtggcc ctggggcaag aggttgctat caagcagatt    840
aatttacaga acaaccaaa  gaaggaattg atcattaatg aaattctggt gatgaaagag    900
ttaaagaatc ccaacatagt taacttcttg gacagttacc tgtaggaga  tgagttgttt    960
gtggtaatgg agtacctcgc tggtgggtcc ctcactgatg ttgtaacaga aacctgcatg   1020
gacgaagcgc agattgccgc cgtgtgcaga gagtgtttac aggcgttgga gtttttacat   1080
gctaatcaag tgatccacag agacatcaaa agtgacaatg tgcttttggg aatggaaggc   1140
tcagttaaac ttactgactt cggcttctgt gcccagatca ctcctgaaca gagcaaacgc   1200
agtactatgg ttggaacacc gtactggatg gcaccagagg tggtgacacg gaaagcctat   1260
ggtcccaaag ttgacatatg gtctctgggc atcatggcta cgagatggt  tgaaggagag   1320
cctccatacc tcaacgaaaa tcctctgcgg gcattatacc tgatagctac aaatggaact   1380
cctgaacttc agaatccaga aaactttcc  ccaatatttc tggattttct aaatcggtgt   1440
ttggaaatgg atgtggagaa aaggggttcg gccaaggaac tgttacagca tcccttcctg   1500
aaactggcca accattgtc  tagcttgacg ccactgatcc tggcagctaa agaagcaatg   1560
aagagtaacc gctaa                                                    1575
```

SEQ ID NO: 60 Mus musculus p21 (RAC1) activated kinase 2 (PAK2)
cDNA, transcript variant X1 (XM_006522072)

```
atgtctgata acggagagct agaagacaag cccccagcac ctccagttcg gatgagcagt     60
accatttta  gcaccggagg aaaagatcct ttatcagcca atcacagttt gaaacctttg    120
ccttctgttc cagaggaaaa aaacccagg  aacaaaatca tctccatatt ctctggcaca    180
gaaaaggaa  gtaaaagaa  agaaaaagaa cggccagaga tttctccccc atctgatttt    240
gagcacacca tccatgttgg ctttgatgct gttacgggag agttcactgg catgccagaa    300
cagtgggcgc ggctgttgca gacctccaac attaccaaac tcgagcagaa gaagaaccct    360
caggcagtgc tggatgtctt gaagttctac gactccaaca ctgtgaaaca gaagtacctg    420
agtttcactc ctcctgagaa agatggcttc ccttctggaa caccagcact gaacaccaag    480
gggtcagaga catcagctgt agtgacagag gaagatgatg atgatgaaga cgctgctcct    540
cccgtcattg cccctcggcc agatcataca aaatcaattt acacacggtc tgtcatcgac    600
cccattcctg ctccagttgg tgattctaat gttgacagtg gtgccaagtc ttcagacaaa    660
cagaaaaaga aagccaagat gaccgatgaa gagattatgg agaaattaag aactattgtg    720
agcataggg  acccaaagaa aaaatacaca agatatgaaa aaattgggca aggggcttct    780
ggaacagttt ttactgccac tgatgtggcc ctggggcaag aggttgctat caagcagatt    840
aatttacaga acaaccaaa  gaaggaattg atcattaatg aaattctggt gatgaaagag    900
ttaaagaatc ccaacatagt taacttcttg gacagttacc tggtaggaga tgagttgttt    960
gtggtaatgg agtacctcgc tggtgggtcc ctcactgatg ttgtaacaga aacctgcatg   1020
gacgaagcgc agattgccgc cgtgtgcaga gagtgtttac aggcgttgga gtttttacat   1080
gctaatcaag tgatccacag agacatcaaa agtgacaatg tgcttttggg aatggaaggc   1140
tcagttaaac ttactgactt cggcttctgt gcccagatca ctcctgaaca gagcaaacgc   1200
agtactatgg ttggaacacc gtactggatg gcaccagagg tggtgacacg gaaagcctat   1260
ggtcccaaag ttgacatatg gtctctgggc atcatggcta cgagatggt  tgaaggagag   1320
cctccatacc tcaacgaaaa tcctctgcgg gcattatacc tgatagctac aaatggaact   1380
```

TABLE 2-continued

```
cctgaacttc agaatccaga aaaactttcc ccaatatttc gggatttctt aaatcggtgt   1440
ttggaaatgg atgtggagaa aaggggttcg gccaaggaac tgttacagca tcctttcctg   1500
aaactggcca aaccattgtc tagcttgacg ccactgatcc tggcagctaa agaagcaatg   1560
aagagtaacg ctaacatcg tcaccgaggc ctccctattcc cttatccatt ttttaaaga    1620
agtctttta                                                          1629
```

SEQ ID NO: 61 *Mus musculus* p21 (RAC1) activated kinase 2 (PAK2)
amino acid sequence (NP_796300)

```
MSDNGELEDK PPAPPVRMSS TIFSTGGKDP LSANHSLKPL PSVPEEKKPR NKIISIFSGT    60
EKGSKKKEKE RPEISPPSDF EHTIHVGFDA VTGEFTGMPE QWARLLQTSN ITKLEQKKNP   120
QAVLDVLKFY DSNTVKQKYL SFTPPEKDGF PSGTPALNTK GSETSAVVTE EDDDDEDAAP   180
PVIAPRPDHT KSIYTRSVID PIPAPVGDSN VDSGAKSSDK QKKKAKMTDE EIMEKLRTIV   240
SIGDPKKKYT RYEKIGQGAS GTVFTATDVA LGQEVAIKQI NLQKQPKKEL IINEILVMKE   300
LKNPNIVNFL DSYLVGDELF VVMEYLAGGS LTDVVTETCM DEAQIAAVCR ECLQALEFLH   360
ANQVIHRDIK SDNVLLGMEG SVKLTDFGFC AQITPEQSKR STMVGTPYWM APEVVTRKAY   420
GPKVDIWSLG IMAIEMVEGE PPYLNENPLR ALYLIATNGT PELQNPEKLS PIFRDFLNRC   480
LEMDVEKRGS AKELLQHPFL KLAKPLSSLT PLILAAKEAM KSNR                    524
```

SEQ ID NO: 62 *Mus musculus* p21 (RAC1) activated kinase 2 (PAK2)
amino acid sequence, isoform X1 (XP_006522135)

```
MSDNGELEDK PPAPPVRMSS TIFSTGGKDP LSANHSLKPL PSVPEEKKPR NKIISIFSGT    60
EKGSKKKEKE RPEISPPSDF EHTIHVGFDA VTGEFTGMPE QWARLLQTSN ITKLEQKKNP   120
QAVLDVLKFY DSNTVKQKYL SFTPPEKDGF PSGTPALNTK GSETSAVVTE EDDDDEDAAP   180
PVIAPRPDHT KSIYTRSVID PIPAPVGDSN VDSGAKSSDK QKKKAKMTDE EIMEKLRTIV   240
SIGDPKKKYT RYEKIGQGAS GTVFTATDVA LGQEVAIKQI NLQKQPKKEL IINEILVMKE   300
LKNPNIVNFL DSYLVGDELF VVMEYLAGGS LTDVVTETCM DEAQIAAVCR ECLQALEFLH   360
ANQVIHRDIK SDNVLLGMEG SVKLTDFGFC AQITPEQSKR STMVGTPYWM APEVVTRKAY   420
GPKVDIWSLG IMAIEMVEGE PPYLNENPLR ALYLIATNGT PELQNPEKLS PIFRDFLNRC   480
LEMDVEKRGS AKELLQHPFL KLAKPLSSLT PLILAAKEAM KSNR                    524
```

SEQ ID NO: 63 *Rattus norvegicus* (rat) p21 (RAC1) activated kinase 2
(PAK2) cDNA, transcript variant X1 (XM_003751066)

```
atgtctgata acggggagct agaggacaag cccccagcac ctccagtgcg gatgagcagc    60
accatttta gcactggagg aaaggatcct ttatcagcca atcacagttt gaagcctttg   120
ccttctgttc cagaggaaaa aaaaccgagg aacaaaatca tctccatatt ctcaagcaca   180
gaaaaaggaa gtaaaagaa agaaaaagaa cggccagaga tttctccgcc gtctgatttt   240
gagcatacca tccatgttgg ctttgatgct gttacgggag agttcactgg catgccagag   300
cagtgggcac ggctgttgca gacctccaac attaccaaac tggagcagaa gaagaacccg   360
caggctgtgc tggatgtctt gaagttctac gactccaaca ctgtgaagca gaagtacctg   420
agcttcactc ctcctgagaa agatggcttt ccttctggaa caccagcact gaacaccaag   480
gggtcagaga catcagctgt ggtgacagag gaagacgatg acgatgaaga tgctgctcct   540
cccgtcattg cccctcggcc agatcataca aaatcaatct acacaaggtc tgtcatcgac   600
cctattcctg ctccagttgg tgactctaat gtcgacagtg gtgccaagtc ttcagacaaa   660
cagaaaaaga aagccaagat gaccgatgaa gagattatgg agaaattaag aactattgtg   720
agcataggtg accctaagaa aaaatacaca agatatgaaa aaatcgggca aggggcttct   780
ggtacagttt ttactgcaac tgatgtggcc ctggggcaag aggttgctat caagcagatt   840
aatttacaga aacaaccaaa gaaggaattg atcattaatg aaattctggt gatgaaagag   900
ttaaagaatc ccaacatagt taacttcttg gacagttacc tggtaggaga cgagttgttt   960
gtggtaatgg agtaccttgc tggtgggtcc ctcactgatg tcgtgacaga aacctgcatg  1020
gatgaagcgc agatcgcagc tgtgtgcaga gagtgtttac aggcgttgga gtttttacat  1080
gctaatcaag tgatccacag agacatcaaa agtgacaatg tgcttttggg aatggaaggc  1140
tcagttaaac tcactgattt tggcttctgt gcccagatca ccctgaacca gagcaaacgc  1200
agtactatgg ttgaacacac atactggatg gcaccggagg tagtcacgcg aaagcctat   1260
ggcccccaaa ttgacatatg gtctctgggc atcatggcta tcgaaatggt ggaaggagag  1320
cctccatacc tcaatgaaaa tccttacgg gcattatacc tgatagcaac gaatggaaca  1380
cctgagctcc agaatccaga aaaactttcc cccatatttc gggatttctt aaatcggtgt  1440
ttggaaatgg atgtggagaa gaggggttca gccaagaaac tattacagca tcctttcctg  1500
aaactggcca aaccattatc cagcttgacg cctctgatcc tggcagctaa agaagcaatg  1560
aagagtaacc gctaa                                                   1575
```

SEQ ID NO: 64 *Rattus norvegicus* (rat) p21 (RAC1) activated kinase 2
(PAK2) cDNA, transcript variant X1 (XM_008768776)

```
atgtctgata acggggagct agaggacaag cccccagcac ctccagtgcg gatgagcagc    60
accattttta gcactggagg aaaggatcct ttatcagcca atcacagttt gaagcctttg   120
ccttctgttc cagaggaaaa aaaaccgagg aacaaaatca tctccatatt ctcaagcaca   180
gaaaaaggaa gtaaaagaa agaaaaagaa cggccagaga tttctccgcc gtctgatttt   240
gagcatacca tccatgttgg ctttgatgct gttacgggag agttcactgg catgccagag   300
cagtgggcac ggctgttgca gacctccaac attaccaaac tggagcagaa gaagaacccg   360
caggctgtgc tggatgtctt gaagttctac gactccaaca ctgtgaagca gaagtacctg   420
agcttcactc ctcctgagaa agatggcttt ccttctggaa caccagcact gaacaccaag   480
gggtcagaga catcagctgt ggtgacagag gaagacgatg acgatgaaga tgctgctcct   540
cccgtcattg cccctcggcc agatcataca aaatcaatct acacaaggtc tgtcatcgac   600
cctattcctg ctccagttgg tgactctaat gtcgacagtg gtgccaagtc ttcagacaaa   660
cagaaaaaga aagccaagat gaccgatgaa gagattatgg agaaattaag aactattgtg   720
agcataggtg accctaagaa aaaatacaca agatatgaaa aaatcgggca aggggcttct   780
ggtacagttt ttactgcaac tgatgtggcc ctggggcaag aggttgctat caagcagatt   840
```

TABLE 2-continued

```
aatttacaga aacaaccaaa gaaggaattg atcattaatg aaattctggt gatgaaagag    900
ttaaagaatc ccaacatagt taacttcttg gacagttacc tggtaggaga cgagttgttt    960
gtggtaatgg agtaccttgc tggtgggtcc ctcactgatg tcgtgacaga aacctgcatg   1020
gatgaagcgc agatcgcagc tgtgtgcaga gagtgtttac aggcgttgga gttttttacat 1080
gctaatcaag tgatccacag agacatcaaa agtgacaatg tgcttttggg aatggaaggc   1140
tcagttaaac tcactgattt tggcttctgt gcccagatca ccctgaaca gagcaaacgc    1200
agtactatgg ttggaacacc atactggatg gcaccggagg tagtcacgcg aaagcctat    1260
ggccccaaag ttgacatatg gtctctgggc atcatggcta tcgaaatggt ggaaggagag   1320
cctccatacc tcaatgaaaa tccttttacgg gcattatacc tgatagcaac gaatggaaca  1380
cctgagctcc agaatccaga aaaactttcc cccatatttc gggatttctt aaatcggtgt   1440
ttggaaatgg atgtggagaa gaggggttca gccaaagaac tattacagca tccttttcctg 1500
aaactggcca aaccattatc cagcttgacg cctctgatcc tggcagctaa agaagcaatg   1560
aagagtaacc gctaa                                                    1575
```

SEQ ID NO: 65 *Rattus norvegicus* (rat) p21 (RAC1) activated kinase 2
(PAK2) cDNA, transcript variant X3 (XM_006248473)

```
atgtctgata acggggagct agaggacaag ccccagcac ctccagtgcg gatgagcagc     60
accattttta gcactggagg aaaggatcct ttatcagcca atcacagttt gaagcctttg   120
ccttctgttc cagaggaaaa aaaaccgagg aacaaaatca tctccatatt ctcaagcaca   180
gaaaaaggaa gtaaaaagaa agaaaaagaa cggccaaatc tttctccgcc gtctgatttt   240
gagcatacca tccatgttgg ctttgatgct gttacgggag agttcactgg catgccagag   300
cagtgggcac ggctgttgca gacctccaac attaccaaac tggagcagaa gaagaacccg   360
caggctgtgc tggatgtctt gaagttctac gactccaaca ctgtgaagca gaagtacctg   420
agcttcactc ctcctgagaa agatggcttt ccttctggaa ccaccagcact gaacaccaag   480
gggtcagaga catcagctgt ggtgacagag gaagacgatg acgatgaaga tgctgctcct   540
cccgtcattg cccctcggcc agatcataca aaatcaatct acacaaggtc tgtcatcgac   600
cctattcctg ctccagttgg tgactctaat gtcgacagtg gtgccaagtc ttcagacaaa   660
cagaaaaaga aagccaagat gaccgatgaa gagattatgg agaaattaag aactattgtg   720
agcataggtg accctaagaa aaaatacaca agatatgaaa aaatcgggca aggggcttct   780
ggtacagttt ttactgcaac tgatgtggcc ctggggcaag aggttgctat caagcagatt   840
aatttacaga aacaaccaaa gaaggaattg atcattaatg aaattctggt gatgaaagag   900
ttaaagaatc ccaacatagt taacttcttg gacagttacc tggtaggaga cgagttgttt    960
gtggtaatgg agtaccttgc tggtgggtcc ctcactgatg tcgtgacaga aacctgcatg   1020
gatgaagcgc agatcgcagc tgtgtgcaga gagtgtttac aggcgttgga gttttttacat 1080
gctaatcaag tgatccacag agacatcaaa agtgacaatg tgcttttggg aatggaaggc   1140
tcagttaaac tcactgattt tggcttctgt gcccagatca ccctgaaca gagcaaacgc    1200
agtactatgg ttggaacacc atactggatg gcaccggagg tagtcacgcg aaagcctat    1260
ggccccaaag ttgacatatg gtctctgggc atcatggcta tcgaaatggt ggaaggagag   1320
cctccatacc tcaatgaaaa tccttttacgg gcattatacc tgatagcaac gaatggaaca  1380
cctgagctcc agaatccaga aaaactttcc cccatatttc gggatttctt aaatcggtgt   1440
ttggaaatgg atgtggagaa gaggggttca gccaaagaac tattacagca tccttttcctg 1500
aaactggcca aaccattatc cagcttgacg cctctgatcc tggcagctaa agaagcaatg   1560
aagagtaacc gctaa                                                    1575
```

SEQ ID NO: 66 *Rattus norvegicus* (rat) p21 (RAC1) activated kinase 2
(PAK2) amino acid sequence (XP_008767000)

```
MSDNGELEDK PPAPPVRMSS TIFSTGGKDP LSANHSLKPL PSVPEEKKPR NKIISIFSST    60
EKGSKKKEKE RPEISPPSDF EHTIHVGFDA VTGEFTGMPE QWARLLQTSN ITKLEQKKNP   120
QAVLDVLKFY DSNTVKQKYL SFTPPEKDGF PSGTPALNTK GSETSAVVTE EDDDDEDAAP   180
PVIAPRPDHT KSIYTRSVID PIPAPVGDSN VDSGAKSSDK QKKKAKMTDE EIMEKLRTIV   240
SIGDPKKKYT RYEKIGQGAS GTVFTATDVA LGQEVAIKQI NLQKQPKKEL IINEILVMKE   300
LKNPNIVNFL DSYLVGDELF VVMEYLAGGS LTDVVTETCM DEAQIAAVCR ECLQALEFLH   360
ANQVIHRDIK SDNVLLGMEG SVKLTDFGFC AQITPEQSKR STMVGTPYWM APEVVTRKAY   420
GPKVDIWSLG IMAIEMVEGE PPYLNENPLR ALYLIATNGT PELQNPEKLS PIFRDFLNRC   480
LEMDVEKRGS AKELLQHPFL KLAKPLSSLT PLILAAKEAM KSNR                    524
```

SEQ ID NO: 67 *Rattus norvegicus* (rat) p21 (RAC1) activated kinase 2
(PAK2) amino acid sequence (XP_006248535)

```
MSDNGELEDK PPAPPVRMSS TIFSTGGKDP LSANHSLKPL PSVPEEKKPR NKIISIFSST    60
EKGSKKKEKE RPEISPPSDF EHTIHVGFDA VTGEFTGMPE QWARLLQTSN ITKLEQKKNP   120
QAVLDVLKFY DSNTVKQKYL SFTPPEKDGF PSGTPALNTK GSETSAVVTE EDDDDEDAAP   180
PVIAPRPDHT KSIYTRSVID PIPAPVGDSN VDSGAKSSDK QKKKAKMTDE EIMEKLRTIV   240
SIGDPKKKYT RYEKIGQGAS GTVFTATDVA LGQEVAIKQI NLQKQPKKEL IINEILVMKE   300
LKNPNIVNFL DSYLVGDELF VVMEYLAGGS LTDVVTETCM DEAQIAAVCR ECLQALEFLH   360
ANQVIHRDIK SDNVLLGMEG SVKLTDEGFC AQITPEQSKR STMVGTPYWM APEVVTRKAY   420
GPKVDIWSLG IMAIEMVEGE PPYLNENPLR ALYLIATNGT PELQNPEKLS PIFRDFLNRC   480
LEMDVEKRGS AKELLQHPFL KLAKPLSSLT PLILAAKEAM KSNR                    524
```

SEQ ID NO: 68 *Rattus norvegicus* (rat) p21 (RAC1) activated kinase 2
(PAK2) amino acid sequence (XP_003751114)

```
MSDNGELEDK PPAPPVRMSS TIFSTGGKDP LSANHSLKPL PSVPEEKKPR NKIISIFSST    60
EKGSKKKEKE RPEISPPSDF EHTIHVGFDA VTGEFTGMPE QWARLLQTSN ITKLEQKKNP   120
QAVLDVLKFY DSNTVKQKYL SFTPPEKDGF PSGTPALNTK GSETSAVVTE EDDDDEDAAP   180
PVIAPRPDHT KSIYTRSVID PIPAPVGDSN VDSGAKSSDK QKKKAKMTDE EIMEKLRTIV   240
SIGDPKKKYT RYEKIGQGAS GTVFTATDVA LGQEVAIKQI NLQKQPKKEL IINEILVMKE   300
LKNPNIVNFL DSYLVGDELF VVMEYLAGGS LTDVVTETCM DEAQIAAVCR ECLQALEFLH   360
```

TABLE 2-continued

```
ANQVIHRDIK SDNVLLGMEG SVKLTDEGFC AQITPEQSKR STMVGTPYWM APEVVTRKAY    420
GPKVDIWSLG IMAIEMVEGE PPYLNENPLR ALYLIATNGT PELQNPEKLS PIFRDFLNRC    480
LEMDVEKRGS AKELLQHPFL KLAKPLSSLT PLILAAKEAM KSNR                     524
```

SEQ ID NO: 69 *Gallus gallus* (chicken) p21 (RAC1) activated kinase 2
(PAK2) cDNA, transcript variant X1 (XM_422671)

```
atgtctgaca acggagaact ggaagacaag ccaccagctc ctcctgtgcg atgagcagt      60
tatgggggaa aggacccgtt gtctgccaac cacagcttga aacctctgcc ctccgtacca    120
gaagagagaa aacctaggaa taaaatcatc tccatattct ctagcactga aaaaggaagc    180
aagaagaagg aaaaggaacg accagaaatc tccccgccgt cagactttga gcatactatc    240
catgttggct tgatgctgt cactggagag ttcactggaa tgccagagca atgggctcgg    300
ttgctacaga cctcaaacat caccaagtta gaacagaaga aaaaccctca ggcggtacta    360
gatgtgctga aattctacga ctccaaagac acagcaaaac agaaatatct gagcttttct    420
gctccagaaa aagatggctt cccttcagga acaccaacga ccaatgccaa aggttcagag    480
ccatcaacag ctgtggcaga tgacgatgac gatgatgaag aagcacctcc tcctattatt    540
gctccgcggc cagatcacac gaaatcgatt tatacacggt ctgtaattga ccccatccct    600
gcaccagctg gtgacgcttc tgttgatggt gggacaaagt caggtgataa gcagaaaaag    660
aagaccaaaa tgtcagatga agagatcatg gaaaaactac gtaccattgt gagcataggt    720
gatcccaaga aaaaatacac cagatatgaa aaaattgggc aggggcttc aggtacagtt     780
ttcacagcta ttgacgtggc tactgggcag gaggttgcta tcaaacagat aaacctgcag    840
aaacagccca agaaggagtt gattattaat gagatcttgg taatgaagga actaaagaac    900
cccaacatag tcaacttcct ggacagttac ctcgtaggag atgaactgtt tgtggtgatg    960
gagtatctag ctggaggctc actaacagat gtggttacgg aaacatgtat ggatgaagca   1020
cagattgctg ctgtttgcag ggagtgcttg caagcgcttg agttcctcca tgccaaccag   1080
gtcatccaca gagatataaa gagcgacaac gtgctgctag aatggatgg atcagttaaa    1140
ctaaccgact ttggtttctg tgctcagatc accccagagc agagcaagcg cagcactatg   1200
gttggaacac cttactggat ggctcctgaa gtcgtcacac ggaaagccta tggccctaaa   1260
gtggatatct ggtccctagg catcatggct attgagatgg tggaaggaga accccgtac    1320
ctcaatgaaa accccctgag ggcgttatat ttgatagcaa ctaacggcac accagagctt   1380
cagaaccctg agaaactgtc cccaatattc cggatttct taaaccgatg tttggagatg    1440
gatgttgaga aagaggatc agccaaagaa ttgctacagc atcccttctt gaaattggcc    1500
aaaccctctg ctagcttgac gccactgatc ctggcagcca aagaagcaat gaagagtaac   1560
cgctaa                                                             1566
```

SEQ ID NO: 70 *Gallus gallus* (chicken) p21 (RAC1) activated kinase 2
(PAK2) cDNA transcript variant X2 (XM_004936995)

```
atgtctgaca acggagaact ggaagacaag ccaccagctc ctcctgtgcg atgagcagt      60
tatgggggaa aggacccgtt gtctgccaac cacagcttga aacctctgcc ctccgtacca    120
gaagagagaa aacctaggaa taaaatcatc tccatattct ctagcactga aaaaggaagc    180
aagaagaagg aaaaggaacg accagaaatc tccccgccgt cagactttga gcatactatc    240
catgttggct tgatgctgt cactggagag ttcactggaa tgccagagca atgggctcgg    300
ttgctacaga cctcaaacat caccaagtta gaacagaaga aaaaccctca ggcggtacta    360
gatgtgctga aattctacga ctccaaagac acagcaaaac agaaatatct gagcttttct    420
gctccagaaa aagatggctt cccttcagga acaccaacga ccaatgccaa aggttcagag    480
ccatcaacag ctgtggcaga tgacgatgac gatgatgaag aagcacctcc tcctattatt    540
gctccgcggc cagatcacac gaaatcgatt tatacacggt ctgtaattga ccccatccct    600
gcaccagctg gtgacgcttc tgttgatggt gggacaaagt caggtgataa gcagaaaaag    660
aagaccaaaa tgtcagatga agagatcatg gaaaaactac gtaccattgt gagcataggt    720
gatcccaaga aaaaatacac cagatatgaa aaaattgggc aggggcttc aggtacagtt     780
ttcacagcta ttgacgtggc tactgggcag gaggttgcta tcaaacagat aaacctgcag    840
aaacagccca agaaggagtt gattattaat gagatcttgg taatgaagga actaaagaac    900
cccaacatag tcaacttcct ggacagttac ctcgtaggag atgaactgtt tgtggtgatg    960
gagtatctag ctggaggctc actaacagat gtggttacgg aaacatgtat ggatgaagca   1020
cagattgctg ctgtttgcag ggagtgcttg caagcgcttg agttcctcca tgccaaccag   1080
gtcatccaca gagatataaa gagcgacaac gtgctgctag aatggatgg atcagttaaa    1140
ctaaccgact ttggtttctg tgctcagatc accccagagc agagcaagcg cagcactatg   1200
gttggaacac cttactggat ggctcctgaa gtcgtcacac ggaaagccta tggccctaaa   1260
gtggatatct ggtccctagg catcatggct attgagatgg tggaaggaga accccgtac    1320
ctcaatgaaa accccctgag ggcgttatat ttgatagcaa ctaacggcac accagagctt   1380
cagaaccctg agaaactgtc cccaatattc cggatttct taaaccgatg tttggagatg    1440
gatgttgaga aagaggatc agccaaagaa ttgctacagc atcccttctt gaaattggcc    1500
aaaccctctg ctagcttgac gccactgatc ctggcagcca aagaagcaat gaagagtaac   1560
cgctaa                                                             1566
```

SEQ ID NO: 71 *Gallus gallus* (chicken) p21 (RAC1) activated kinase 2
(PAK2) amino acid sequence (XP_422671)

```
MSDNGELEDK PPAPPVRMSS YGGKDPLSAN HSLKPLPSVP EERKPRNKII SIFSSTEKGS     60
KKKEKERPEI SPPSDFEHTI HVGFDAVTGE FTGMPEQWAR LLQTSNITKL EQKKNPQAVL    120
DVLKFYDSKD TAKQKYLSFS APEKDGFPSG TPTTNAKGSE PSTAVADDDD DDEEAPPPII    180
APRPDHTKSI YTRSVIDPIP APAGDASVDG GTKSGDKQKK KTKMSDEEIM EKLRTIVSIG    240
DPKKKYTRYE KIGQGASGTV FTAIDVATGQ EVAIKQINLQ KQPKKELIIN EILVMKELKN    300
PNIVNFLDSY LVGDELFVVM EYLAGGSLTD VVTETCMDEA QIAAVCRECL QALEFLHANQ    360
VIHRDIKSDN VLLGMDGSVK LTDFGFCAQI TPEQSKRSTM VGTPYWMAPE VVTRKAYGPK    420
VDIWSLGIMA IEMVEGEPPY LNENPLRALY LIATNGTPEL QNPEKLSPIF RDFLNRCLEM    480
DVEKRGSAKE LLQHPFLKLA KPLSSLTPLI LAAKEAMKSN R                        521
```

TABLE 2-continued

SEQ ID NO: 72 Gallus gallus (chicken) p21 (RAC1) activated kinase 2 (PAK2) amino acid sequence (XP_004937052)

```
MSDNGELEDK PPAPPVRMSS YGGKDPLSAN HSLKPLPSVP EERKPRNKII SIFSSTEKGS    60
KKKEKERPEI SPPSDFEHTI HVGFDAVTGE FTGMPEQWAR LLQTSNITKL EQKKNPQAVL   120
DVLKFYDSKD TAKQKYLSFS APEKDGFPSG TPTTNAKGSE PSTAVADDDD DDEEAPPPII   180
APRPDHTKSI YTRSVIDPIP APAGDASVDG GTKSGDKQKK KTKMSDEEIM EKLRTIVSIG   240
DPKKKYTRYE KIGQGASGTV FTAIDVATGQ EVAIKQINLQ KQPKKELIIN EILVMKELKN   300
PNIVNFLDSY LVGDELFVVM EYLAGGSLTD VVTETCMDEA QIAAVCRECL QALEFLHANQ   360
VIHRDIKSDN VLLGMDGSVK LTDFGFCAQI TPEQSKRSTM VGTPYWMAPE VVTRKAYGPK   420
VDIWSLGIMA IEMVEGEPPY LNENPLRALY LIATNGTPEL QNPEKLSPIF RDFLNRCLEM   480
DVEKRGSAKE LLQHPFLKLA KPLSSLTPLI LAAKEAMKSN R                       521
```

SEQ ID NO: 73 Xenopus tropicalis (frog) p21 (RAC1) activated kinase 2 (PAK2) cDNA, transcript variant X1 (XM_002935099)

```
atgtctgata acggggagct tgaagataag ccgccagctc ctccagctcg gattagcagc     60
acagggacaa aagatcctct gaccagcaac cacagtcata aacctttacc tttaatccct   120
gaaaaaccca ggaataaaat tatttcaatg ttttctggca cagaaaaagg aagcagaaaa   180
aaagaaaggg aaaggccaga gatttcacca ccgtcagatt ttgagcacac tattcatgtg   240
ggctttgatg ctgtcactgg agaattcact ggaatgccag agcaatgggc acggttactg   300
cagacctcaa acattactaa actcgaacag aagaaaaatc cacaagctgt cctggatgtt   360
ttaaagtttt atgactccaa acacacagac aagcagaaat atctaagctt ctctgcacca   420
gataaagatg ggcttccctc tggtgtttcc tctgcaccta atgcaaaagg ctctgaacct   480
tcaacagcag caacagatga tgatagcgat gatgataagg ctcctcctcc tgttattgct   540
ccaaggccag aacacaccaa atcaatgtat acacggtctg taattgaccc aatacctcca   600
ccccctggag attcagacag tgctgcaaag gctggagacc ggcagaaaaa gaaaacaaag   660
atgagcgatg aagagattat ggaaaaactt agaactatag taagcatagg agacccaag    720
aaaaaatata ctagatatga aaaaattgga caaggggcct ctggaactgt atttactgct   780
attgatgtag ctaccggaca ggaggttgca atcaaacaga taaatcttca gaagcagccc   840
aagaaagaac tgataatcaa tgagattcta gtgatgaaaa aattgaagaa ccccaatata   900
gtaaatttcc tggacagttt cttggtgagt gacgagctgt atgttgtaat ggagtatttg   960
gctggaggat cccttacaga cgtagtcaca gaaacctgta tggatgaggc acagatagca  1020
gctgtctgca gagagtgtct gcaagctttg gaattcctac atgcgaacca ggtcattcac  1080
agagacataa agagtgacaa tgttctcctt ggaatggatg gttctgtcaa actgaccgac  1140
tttggcttct gtgcacaaat taccccagaa cagagcaagc gaagcaccat ggtgggaaca  1200
ccatactgga tggcaccaga agtggttaca aggaaagcat atggcccaa ggtggatatc   1260
tggtcacttg gaattatggc tattgaaatg gtggaagggg aaccacctta tctcaacgaa  1320
aatcctttaa gggctttgta tttgattgct actaatggaa ctccggaact tcagaaacct  1380
gaaaaacttt caccgatatt ccgggatttc ttaaaccgct cacttgagat ggatgtagaa  1440
aagagagggt ccgctagaga gctcttacag cacccattcc tgaaactcgc aaaaccactg  1500
tccagcctca caccgctaat cctggctgcc aaagaagcga tgaagggaaa ccgctaa     1557
```

SEQ ID NO: 74 Xenopus tropicalis (frog) p21 (RAC1) activated kinase 2 (PAK2) cDNA, transcript variant X2 (XM_012971043)

```
atgtctgata acggggagct tgaagataag ccgccagctc ctccagctcg gattagcagc     60
acagggacaa aagatcctct gaccagcaac cacagtcata aacctttacc tttaatccct   120
gaaaaaccca ggaataaaat tatttcaatg ttttctggca cagaaaaagg aagcagaaaa   180
aaagaaaggg aaaggccaga gatttcacca ccgtcagatt ttgagcacac tattcatgtg   240
ggctttgatg ctgtcactgg agaattcact ggaatgccag agcaatgggc acggttactg   300
cagacctcaa acattactaa actcgaacag aagaaaaatc cacaagctgt cctggatgtt   360
ttaaagtttt atgactccaa acacacagac aagcagaaat atctaagctt ctctgcacca   420
gataaagatg ggcttccctc tggtgtttcc tctgcaccta atgcaaaagg ctctgaacct   480
tcaacagcag caacagatga tgatagcgat gatgataagg ctcctcctcc tgttattgct   540
ccaaggccag aacacaccaa atcaatgtat acacggtctg taattgaccc aatacctcca   600
ccccctggag attcagacag tgctgcaaag gctggagacc ggcagaaaaa gaaaacaaag   660
atgagcgatg aagagattat ggaaaaactt agaactatag taagcatagg agacccaag    720
aaaaaatata ctagatatga aaaaattgga caaggggcct ctggaactgt atttactgct   780
attgatgtag ctaccggaca ggaggttgca atcaaacaga taaatcttca gaagcagccc   840
aagaaagaac tgataatcaa tgagattcta gtgatgaaaa aattgaagaa ccccaatata   900
gtaaatttcc tggacagttt cttggtgagt gacgagctgt atgttgtaat ggagtatttg   960
gctggaggat cccttacaga cgtagtcaca gaaacctgta tggatgaggc acagatagca  1020
gctgtctgca gagagtgtct gcaagctttg gaattcctac atgcgaacca ggtcattcac  1080
agagacataa agagtgacaa tgttctcctt ggaatggatg gttctgtcaa actgaccgac  1140
tttggcttct gtgcacaaat taccccagaa cagagcaagc gaagcaccat ggtgggaaca  1200
ccatactgga tggcaccaga agtggttaca aggaaagcat atggcccaa ggtggatatc   1260
tggtcacttg gaattatggc tattgaaatg gtggaagggg aaccacctta tctcaacgaa  1320
aatcctttaa gggctttgta tttgattgct actaatggaa ctccggaact tcagaaacct  1380
gaaaaacttt caccgatatt ccgggatttc ttaaaccgct cacttgagat ggatgtagaa  1440
aagagagggt ccgctagaga gctcttacag cacccattcc tgaaactcgc aaaaccactg  1500
tccagcctca caccgctaat cctggctgcc aaagaagcga tgaagggaaa ccgctaa     1557
```

SEQ ID NO: 75 Xenopus tropicalis (frog) p21 (RAC1) activated kinase 2 (PAK2) cDNA, transcript variant X3 (XM_012971044)

```
atgtctgata acggggagct tgaagataag ccgccagctc ctccagctcg gattagcagc     60
acagggacaa aagatcctct gaccagcaac cacagtcata aacctttacc tttaatccct   120
gaaaaaccca ggaataaaat tatttcaatg ttttctggca cagaaaaagg aagcagaaaa   180
```

TABLE 2-continued

```
aaagaaaggg aaaggccaga gatttcacca ccgtcagatt ttgagcacac tattcatgtg    240
ggctttgatg ctgtcactgg agaattcact ggaatgccag agcaatgggc acggttactg    300
cagacctcaa acattactaa actcgaacag aagaaaaatc cacaagctgt cctggatgtt    360
ttaaagtttt atgactccaa acacacagac aagcagaaat atctaagctt ctctgcacca    420
gataaagatg ggcttccctc tggtgtttcc tctgcaccta atgcaaaagg ctctgaacct    480
tcaacagcag caacagatga tgatagcgat gatgataagg ctcctcctcc tgttattgct    540
ccaaggccag aacacaccaa atcaatgtat acacggtctg taattgaccc aataccttca    600
cccccctggag attcagacag tgctgcaaag gctggagacc ggcagaaaaa gaaaacaaag    660
atgagcgatg aagagattat ggaaaaactt agaactatag taagcatagg agaccccaag    720
aaaaaatata ctagatatga aaaaattgga caaggggcct ctggaactgt atttactgct    780
attgatgtag ctaccggaca ggaggttgca atcaaacaga taaatcttca gaagcagccc    840
aagaaagaac tgataatcaa tgagattcta gtgatgaaag aattgaagaa ccccaatata    900
gtaaatttcc tggacagttt cttggtgagt gacgagctgt atgttgtaat ggagtatttg    960
gctggaggat cccttacaga cgtagtcaca gaaacctgta tggatgaggc acagatagca   1020
gctgtctgca gagagtgtct gcaagctttg gaattcctac atgcgaacca ggtcattcac   1080
agagacataa agagtgacaa tgttctcctt ggaatggatg gttctgtcaa actgaccgac   1140
tttggcttct gtgcacaaat taccccagaa cagagcaagc gaagcaccat ggtgggaaca   1200
ccatactgga tggcaccaga agtggttaca aggaaagcat atggcccaa ggtggatatc    1260
tggtcacttg gaattatggc tattgaaatg gtggaagggg aaccaccta tctcaacgaa    1320
aatccttta gggctttgta tttgattgct actaatggaa ctccggaact tcagaaacct    1380
gaaaaacttt caccgatatt ccgggatttc ttaaaccgct cacttgagat ggatgtagaa   1440
aagagagggt ccgctagaga gctcttacag cacccattcc tgaaactcgc aaaaccactg   1500
tccagcctca caccgctaat cctggctgcc aaagaagcga tgaagggaaa ccgctaa     1557
```

SEQ ID NO: 76 *Xenopus tropicalis* (frog) p21 (RAC1) activated kinase
2 (PAK2) amino acid sequence (XP_012826498)

```
MSDNGELEDK PPAPPARISS TGTKDPLTSN HSHKPLPLIP EKPRNKIISM FSGTEKGSRK     60
KERERPEISP PSDFEHTIHV GFDAVTGEFT GMPEQWARLL QTSNITKLEQ KKNPQAVLDV    120
LKFYDSKHTD KQKYLSFSAP DKDGLPSGVS SAPNAKGSEP STAATDDDSD DDKAPPPVIA   180
PRPEHTKSMY TRSVIDPIPP PPGDSDSAAK AGDRQKKKTK MSDEEIMEKL RTIVSIGDPK    240
KKYTRYEKIG QGASGTVFTA IDVATGQEVA IKQINLQKQP KKELIINEIL VMKELKNPNI    300
VNFLDSFLVS DELYVVMEYL AGGSLTDVVT ETCMDEAQIA AVCRECLQAL EFLHANQVIH    360
RDIKSDNVLL GMDGSVKLTD FGFCAQITPE QSKRSTMVGT PYWMAPEVVT RKAYGPKVDI    420
WSLGIMAIEM VEGEPPYLNE NPLRALYLIA TNGTPELQKP EKLSPIFRDF LNRSLEMDVE    480
KRGSARELLQ HPFLKLAKPL SSLTPLILAA KEAMKGNR                           518
```

SEQ ID NO: 77 *Xenopus tropicalis* (frog) p21 (RAC1) activated kinase
2 (PAK2) amino acid sequence (XP_012826497)

```
MSDNGELEDK PPAPPARISS TGTKDPLTSN HSHKPLPLIP EKPRNKIISM FSGTEKGSRK     60
KERERPEISP PSDFEHTIHV GFDAVTGEFT GMPEQWARLL QTSNITKLEQ KKNPQAVLDV    120
LKFYDSKHTD KQKYLSFSAP DKDGLPSGVS SAPNAKGSEP STAATDDDSD DDKAPPPVIA   180
PRPEHTKSMY TRSVIDPIPP PPGDSDSAAK AGDRQKKKTK MSDEEIMEKL RTIVSIGDPK    240
KKYTRYEKIG QGASGTVFTA IDVATGQEVA IKQINLQKQP KKELIINEIL VMKELKNPNI    300
VNFLDSFLVS DELYVVMEYL AGGSLTDVVT ETCMDEAQIA AVCRECLQAL EFLHANQVIH    360
RDIKSDNVLL GMDGSVKLTD FGFCAQITPE QSKRSTMVGT PYWMAPEVVT RKAYGPKVDI    420
WSLGIMAIEM VEGEPPYLNE NPLRALYLIA TNGTPELQKP EKLSPIFRDF LNRSLEMDVE    480
KRGSARELLQ HPFLKLAKPL SSLTPLILAA KEAMKGNR                           518
```

SEQ ID NO: 78 *Xenopus tropicalis* (frog) p21 (RAC1) activated kinase
2 (PAK2) amino acid sequence (XP_002935145)

```
MSDNGELEDK PPAPPARISS TGTKDPLTSN HSHKPLPLIP EKPRNKIISM FSGTEKGSRK     60
KERERPEISP PSDFEHTIHV GFDAVTGEFT GMPEQWARLL QTSNITKLEQ KKNPQAVLDV    120
LKFYDSKHTD KQKYLSFSAP DKDGLPSGVS SAPNAKGSEP STAATDDDSD DDKAPPPVIA   180
PRPEHTKSMY TRSVIDPIPP PPGDSDSAAK AGDRQKKKTK MSDEEIMEKL RTIVSIGDPK    240
KKYTRYEKIG QGASGTVFTA IDVATGQEVA IKQINLQKQP KKELIINEIL VMKELKNPNI    300
VNFLDSFLVS DELYVVMEYL AGGSLTDVVT ETCMDEAQIA AVCRECLQAL EFLHANQVIH    360
RDIKSDNVLL GMDGSVKLTD FGFCAQITPE QSKRSTMVGT PYWMAPEVVT RKAYGPKVDI    420
WSLGIMAIEM VEGEPPYLNE NPLRALYLIA TNGTPELQKP EKLSPIFRDF LNRSLEMDVE    480
KRGSARELLQ HPFLKLAKPL SSLTPLILAA KEAMKGNR                           518
```

SEQ ID NO: 79 *Homo sapiens* CRK proto-oncogene, adaptor protein (CRK)
cDNA, transcript variant I (NM_005206)

```
atggcgggca acttcgactc ggaggagcgg agtagctggt actggggag gttgagtcgg     60
caggaggcgg tggcgctgct gcagggccag cggcacgggg tgttcctggt gcgggactcg    120
agcaccagcc ccggggacta tgtgctcagc gtctcagaga actcgcgcgt ctcccactac    180
atcatcaaca gcagcggccc gcgccgccg gtgccaccgt cgcccgccca gcctccgccc    240
ggggtgagcc cctccagact ccgaatagga gatcaagagt ttgattcatt gcctgcttta    300
ctggaattct acaaaatata ctatttggac actacaacgt tgataagaacc agtttccaga    360
tccaggcagg gtagtggagt gattctcagg caggaggacg cggagtatgt gcgagccctc    420
tttgactta atgggaatga tgaggaagat ctttccctta agaaggaga catcttgaga     480
atccgggaca agcctgaaga gcagtggtgg aatgcggagg acagcgaagg caagagaggg    540
atgattccag tcccttacgt cgagaagtat agacctgcct ccgcctcagt atcggctctg    600
attggaggtc ggtga                                                    615
```

TABLE 2-continued

SEQ ID NO: 80 *Homo sapiens* CRK proto-oncogene, adaptor protein (CRK)
cDNA, transcript variant II (NM_016823)

```
atggcgggca acttcgactc ggaggagcgg agtagctggt actggggag gttgagtcgg      60
caggaggcgg tggcgctgct gcagggccag cggcacgggg tgttcctggt gcgggactcg    120
agcaccagcc ccggggacta tgtgctcagc gtctcagaga actcgcgcgt ctcccactac    180
atcatcaaca gcagcggccc gcgccgcg gtgccaccgt cgcccgccca gcctccgccc     240
ggggtgagcc cctccagact ccgaatagga gatcaagagt ttgattcatt gcctgcttta    300
ctggaattct acaaaatca ctatttggac actacaacgt tgatagaacc agtttccaga    360
tccaggcagg gtagtggagt gattctcagg caggaggagg cggagtatgt gcgagccctc    420
tttgacttta tgggaatga tgaggaagat ctttccttta agaaaggaga catcttgaga    480
atccgggaca agcctgaaga gcagtggtgg aatgcggagg acagcgaagg caagagaggg    540
atgattccag tcccttacgt cgagaagtat agacctgcct ccgcctcagt atcggctctg    600
attggaggta accaggaggg ttcccaccca cagccactgg gtgggccgga gcctgggccc    660
tatgcccaac ccagcgtcaa cactccgctc cctaacctcc agaatgggcc catatatgcc    720
agggttatcc agaagcgagt ccccaatgcc tacgacaaga cagccttgc tttggaggtc    780
ggtgagctgg taaaggttac gaagattaat gtgagtggtc agtgggaagg ggagtgtaat    840
ggcaaacgag gtcacttccc attcacacat gtccgtctgc tggatcaaca gaatcccgat    900
gaggacttca gctga                                                    915
```

SEQ ID NO: 81 *Homo sapiens* CRK proto-oncogene, adaptor protein (CRK)
amino acid sequence, isoform A (NP_058431)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSR    120
SRQGSGVILR QEEAEYVRAL FDFNGNDEED LPFKKGDILR IRDKPEEQWW NAEDSEGKRG    180
MIPVPYVEKY RPASASVSAL IGGNQEGSHP QPLGGPEPGP YAQPSVNTPL PNLQNGPIYA    240
RVIQKRVPNA YDKTALALEV GELVKVTKIN VSGQWEGECN GKRGHFPFTH VRLLDQQNPD    300
EDFS                                                                304
```

SEQ ID NO: 82 *Homo sapiens* CRK proto-oncogene, adaptor protein (CRK)
amino acid sequence, isoform B (NP_005197)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSR    120
SRQGSGVILR QEEAEYVRAL FDFNGNDEED LPFKKGDILR IRDKPEEQWW NAEDSEGKRG    180
MIPVPYVEKY RPASASVSAL IGGR                                          204
```

SEQ ID NO: 83 *Pan troglodytes* (chimpanzee) CRK proto-oncogene,
adaptor protein (CRK) cDNA, transcript variant X1 (XM_016931122)

```
atggcgggca acttcgactc ggaggagcgg agtagctggt actgggggcg gttgagtcgg     60
caggaggcgg tggcgctgct gcagggccag cggcacgggg tgttcctggt gcgggactcg    120
agcaccagcc ccggggacta tgtgctcagc gtctcagaga actcgcgcgt ctcccactac    180
atcatcaaca gcagcggccc gcgccgcg gtgccaccgt cgcccgctca gcctccgccc     240
ggggtgagcc cctccagact ccgaatagga gatcaagagt ttgattcatt gcctgcttta    300
ctggaattct acaaaatca ctatttggac actacaacgt tgatagaacc agtttccaga    360
tccaggcagg gtagtggagt gattctcagg caggaggagg cggagtatgt gcgagccctc    420
tttgacttta tgggaatga tgaggaagat ctttccttta agaaaggaga catcttgaga    480
atccgggaca agcctgaaga gcagtggtgg aatgcggagg acagcgaagg caagagaggg    540
atgattccag tcccttacgt cgagaagtat agacctgcct ccgcctcagt atcggctctg    600
attggaggta accaggaggg ttcccaccca cagccactgg gtgggccgga gcctgggccc    660
tatgcccaac ccagcgtcaa cactccgctc cctaacctcc agaatgggcc catatatgcc    720
agggttatcc agaagcgagt ccccaatgcc tacgacaaga cagccttgc tttggaggtc    780
ggtgagctgg taaaggttac gaagattaat gtgagtggtc agtgggaagg ggagtgtaat    840
ggcaaacgag gtcacttccc attcacacat gtccgtctgc tggatcaaca gaatcccgat    900
gaggacttca gctga                                                    915
```

SEQ ID NO: 84 *Pan troglodytes* (chimpanzee) CRK proto-oncogene,
adaptor protein (CRK) cDNA, transcript variant X2 (XM_016931123)

```
atggcgggca acttcgactc ggaggagcgg agtagctggt actgggggcg gttgagtcgg     60
caggaggcgg tggcgctgct gcagggccag cggcacgggg tgttcctggt gcgggactcg    120
agcaccagcc ccggggacta tgtgctcagc gtctcagaga actcgcgcgt ctcccactac    180
atcatcaaca gcagcggccc gcgccgcg gtgccaccgt cgcccgctca gcctccgccc     240
ggggtgagcc cctccagact ccgaatagga gatcaagagt ttgattcatt gcctgcttta    300
ctggaattct acaaaatca ctatttggac actacaacgt tgatagaacc agtttccaga    360
tccaggcagg gtagtggagt gattctcagg caggaggagg cggagtatgt gcgagccctc    420
tttgacttta tgggaatga tgaggaagat ctttccttta agaaaggaga catcttgaga    480
atccgggaca agcctgaaga gcagtggtgg aatgcggagg acagcgaagg caagagaggg    540
atgattccag tcccttacgt cgagaagtat agacctgcct ccgcctcagt atcggctctg    600
attggaggtc ggtga                                                    615
```

SEQ ID NO: 85 *Pan troglodytes* (chimpanzee) CRK proto-oncogene,
adaptor protein (CRK) amino acid sequence, isoform X1
(XP_016786611)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSR    120
```

TABLE 2-continued

```
SRQGSGVILR QEEAEYVRAL FDFNGNDEED LPFKKGDILR IRDKPEEQWW NAEDSEGKRG    180
MIPVPYVEKY RPASASVSAL IGGNQEGSHP QPLGGPEPGP YAQPSVNTPL PNLQNGPIYA    240
RVIQKRVPNA YDKTALALEV GELVKVTKIN VSGQWEGECN GKRGHFPFTH VRLLDQQNPD    300
EDFS                                                                304
```

SEQ ID NO: 86 *Pan troglodytes* (chimpanzee) CRK proto-oncogene, adaptor protein (CRK) amino acid sequence, isoform X2 (XP_016786612)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSR    120
SRQGSGVILR QEEAEYVRAL FDFNGNDEED LPFKKGDILR IRDKPEEQWW NAEDSEGKRG    180
MIPVPYVEKY RPASASVSAL IGGR                                          204
```

SEQ ID NO: 87 *Macaca mulatta* (*Rhesus macaque*) CRK proto-oncogene, adaptor protein (CRK) cDNA, transcript variant X1 (XM_002808109)

```
atggcgggca acttcgactc ggaggagcgg agtagctggt actggggggcg gttgagtcgg     60
caggaggcgg tggcgctgct gcagggccag cggcacgggg tgttcctggt gcgggactcg    120
agcaccagcc ccggggacta tgtgctcagc gtctcagaga actcgcgcgt ctcccactac    180
atcatcaaca gcagcggccc gcgcccgcca gtgccgcgct cgcccgccca acctccgccg    240
ggggtgagcc cctccagact ccgaatagga gatcaagagt ttgattcatt gcctgcttta    300
ctggaattct acaaaataca ctatttggac actacaacgt tgatagaacc ggtttccaga    360
tccaggcagg gtagtggagt gattctcagg caggaggagg cggagtatgt gcgagccctc    420
tttgactta tgggaatga tgaggaagat ctttcctta agaaggaga catcttgaga    480
atccgggaca agcctgaaga gcagtggtgg aatgcggagg acagcgaagg caagagaggg    540
atgattccag tcccttacgt cgagaagtat agacctgcct ccgcctcagt atcggctctg    600
attggaggta accaggaggg ttcccaccca cagccactgg gtgggccgga gcctgggccc    660
tatgcccaac ccagcgtcaa cactccgctc cctaacctcc agaatgggcc catatatgcc    720
agggttatcc agaagcgagt ccccaatgcc tacgacaaga cagccttggc tttggaggtc    780
ggtgagctgg taaaggttac gaagattaat gtgagtggtc agtgggaagg ggagtgtaat    840
ggcaaacgag gtcactcc attcacacat gtccgtctgc tggatcaaca gaatcccgat    900
gaggacttca gctga                                                    915
```

SEQ ID NO: 88 *Macaca mulatta* (*Rhesus macaque*) CRK proto-oncogene, adaptor protein (CRK) cDNA, transcript variant X2 (XM_015118183)

```
atggcgggca acttcgactc ggaggagcgg agtagctggt actggggggcg gttgagtcgg     60
caggaggcgg tggcgctgct gcagggccag cggcacgggg tgttcctggt gcgggactcg    120
agcaccagcc ccggggacta tgtgctcagc gtctcagaga actcgcgcgt ctcccactac    180
atcatcaaca gcagcggccc gcgcccgcca gtgccgcgct cgcccgccca acctccgccg    240
ggggtgagcc cctccagact ccgaatagga gatcaagagt ttgattcatt gcctgcttta    300
ctggaattct acaaaataca ctatttggac actacaacgt tgatagaacc ggtttccaga    360
tccaggcagg gtagtggagt gattctcagg caggaggagg cggagtatgt gcgagccctc    420
tttgactta tgggaatga tgaggaagat ctttcctta agaaggaga catcttgaga    480
atccgggaca agcctgaaga gcagtggtgg aatgcggagg acagcgaagg caagagaggg    540
atgattccag tcccttacgt cgagaagtat agacctgcct ccgcctcagt atcggctctg    600
attggaggtc ggtga                                                    615
```

SEQ ID NO: 89 *Macaca mulatta* (*Rhesus macaque*) CRK proto-oncogene, adaptor protein (CRK) amino acid sequence, isoform X1 (XP_002808155)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSR    120
SRQGSGVILR QEEAEYVRAL FDFNGNDEED LPFKKGDILR IRDKPEEQWW NAEDSEGKRG    180
MIPVPYVEKY RPASASVSAL IGGNQEGSHP QPLGGPEPGP YAQPSVNTPL PNLQNGPIYA    240
RVIQKRVPNA YDKTALALEV GELVKVTKIN VSGQWEGECN GKRGHFPFTH VRLLDQQNPD    300
EDFS                                                                304
```

SEQ ID NO: 90 *Macaca mulatta* (*Rhesus macaque*) CRK proto-oncogene, adaptor protein (CRK) amino acid sequence, isoform X2 (XP_014973669)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSK    120
SRQGSGVILR QEEAEYVRAL FDFNGNDEED LPFKKGDILR IRDKPEEQWW NAEDSEGKRG    180
MIPVPYVEKY RPASASVSAL IGGR                                          204
```

SEQ ID NO: 91 *Canis lupus familiaris* (dog) CRK proto-oncogene, adaptor protein (CRK) cDNA, transcript variant X1 (XM_003435202)

```
atggcgggca acttcgactc ggaggagcgg agtagctggt actggggggcg gttgagccgg     60
caggaggcgg tggcgctgtt gcagggccag cggcacgggg tgtttctggt gcgggactcg    120
agcaccagcc ccggggacta tgtgctcagc gtctcggaga actcgcgcgt ctcccactac    180
atcatcaaca gcagcggccc gcgcccgtct gtgccaccgt cgcccgccca gcctccgccc    240
ggggtgagcc cctccagact ccgaatagga gatcaagagt ttgattcatt gcctgcttta    300
ctggaattct acaaaataca ttatttggac actacaacgt tgatagaacc agtttccaga    360
tccaggcagg gtagtggagt gattctcagg caggaggagg cagagtatgt gcgagccctc    420
tttgactta tgggaatga tgaagaagat ctttcctta agaaggaga catcctgaga    480
atccgagata agcctgaaga gcagtggtgg aatgcagagg acagcgaagg caagaggggg    540
atgattccag tcccttacgt cgagaagtat agacctgcct ccgcctcagt atcggctctg    600
```

TABLE 2-continued

```
attggaggta accaggaggg ttcccaccca cagccactgg gtgggccgga gcctgggccc    660
tatgcccaac ccagcgtcaa cactccgctc cctaacctcc agaatgggcc catttatgcc    720
agggtaatcc agaagcgagt ccctaatgcc tacgacaaga cagccttggc tttggaggtc    780
ggtgagctgg taaaggttac gaagattaat gtgagtggtc agtgggaagg ggaatgtaat    840
ggcaaacgag gtcacttccc attcacacat gtccgtctgc tggatcaaca gaatcctgat    900
gaggacttca gctga                                                     915
```

SEQ ID NO: 92 *Canis lupus familiaris* (dog) CRK proto-oncogene, adaptor protein (CRK) cDNA, transcript variant X2 (XM_003435203)

```
atggcgggca acttcgactc ggaggagcgg agtagctggt actgggggcg gttgagccgg    60
caggaggcgg tggcgctgtt gcagggccag cggcacgggg tgtttctggt gcgggactcg   120
agcaccagcc ccggggacta tgtgctcagc gtctcggaga actcgcgcgt ctcccactac   180
atcatcaaca gcagcggccc gcgcccgtct gtgccaccgt cgcccgccca gcctccgccc   240
ggggtgagcc cctccagact ccgaatagga gatcaagagt ttgattcatt gcctgcttta   300
ctggaattct acaaaatca ttatttggac actacaacgt tgatagaacc agtttccaga   360
tccaggcagg gtagtggaga gattctcagg caggaggagg cagagtatgt gcgagccctc   420
tttgacttta tgggaatga tgaagaagat cttcccttta agaaaggaga catcctgaga   480
atccgagata agcctgaaga gcagtggtgg aatgcagagg acagcgaagg caagagggg    540
atgattccag tcccttacgt cgagaagtat agacctgcct ccgcctcagt atcggctctg   600
attggaggtc ggtga                                                     615
```

SEQ ID NO: 93 *Canis lupus familiaris* (dog) CRK proto-oncogene, adaptor protein (CRK) amino acid sequence, isoform X1 (XP_003435250)

```
MAGNFDSEER SSWYWGRLSR QEAVALLQGQ RHGVFLVRDS STSPGDYVLS VSENSRVSHY    60
IINSSGPRPS VPPSPAQPPP GVSPSRLRIG DQEFDSLPAL LEFYKIHYLD TTTLIEPVSK   120
SRQGSGVILR QEEAEYVRAL FDFNGNDEED LPFKKGDILR IRDKPEEQWW NAEDSEGKRG   180
MIPVPYVEKY RPASASVSAL IGGNQEGSHP QPLGGPEPGP YAQPSVNTPL PNLQNGPIYA   240
RVIQKRVPNA YDKTALALEV GELVKVTKIN VSGQWEGECN GKRGHFPFTH VRLLDQQNPD   300
EDFS                                                                 304
```

SEQ ID NO: 94 *Canis lupus familiaris* (dog) CRK proto-oncogene, adaptor protein (CRK) amino acid sequence, isoform X2 (XP_003435251)

```
MAGNFDSEER SSWYWGRLSR QEAVALLQGQ RHGVFLVRDS STSPGDYVLS VSENSRVSHY    60
IINSSGPRPS VPPSPAQPPP GVSPSRLRIG DQEFDSLPAL LEFYKIHYLD TTTLIEPVSK   120
SRQGSGVILR QEEAEYVRAL FDFNGNDEED LPFKKGDILR IRDKPEEQWW NAEDSEGKRG   180
MIPVPYVEKY RPASASVSAL IGGR                                           204
```

SEQ ID NO: 95 *Bos taurus* (cow) CRK proto-oncogene, adaptor protein (CRK) cDNA (NM_001192334)

```
atggcgggca acttcgactc ggaggagcgg agtagctggt actgggggcg gctgagtcgg    60
caggaggcgg tggcgctgtt gcagggccag cggcacgggg tgttcctggt gcgggactcg   120
agcactagcc ccggggacta tgtgctcagc gtctccgaga actcgcgcgt ctcccactac   180
atcatcaaca gcagcggccc gcgcccgccg gtgccaccgt cgcccgccca gcctccgccc   240
ggggtgagtc cctccagact ccgaatagga gatcaagaat ttgattcatt gcctgcttta   300
ctggaattct acaaaatca ctatttggac actacaacgt tgatagaacc agtttccaga   360
tccaggcagg gtagtggagt gattctcagg caggaagagg cagagtatgt acgagccctc   420
tttgacttta tgggaatga tgaagaagat cttcccttta agaaaggaga catcctgaga   480
atccgggata agcctgaaga gcagtggtgg aatgcggagg acagcgaagg caagagaggg   540
atgattccag tcccttacgt ggagaagtat agacctgcct ccgcctcagt atcggctctg   600
attggaggta accaggaggg ttcccaccca cagccactgg gtgggccgga gcctgggccc    660
tatgcccaac ccagcgtcaa cactccgctc cctaacctcc agaatgggcc catttatgcc    720
agggtaatcc agaagcgagt ccctaatgcc tacgacaaga cagccttggc tttggaggtc    780
ggtgagctgg taaaggttac gaagattaat gtgagtggtc agtgggaagg ggagtgtaat    840
ggcaaacgag gtcacttccc attcacacat gtccgtctgc tggatcaaca gaatcccgat    900
gaggacttca gctga                                                     915
```

SEQ ID NO: 96 *Bos taurus* (cow) CRK proto-oncogene, adaptor protein (CRK) cDNA, transcript variant X1 (XM_005220095)

```
atggcgggca acttcgactc ggaggagcgg agtagctggt actgggggcg gctgagtcgg    60
caggaggcgg tggcgctgtt gcagggccag cggcacgggg tgttcctggt gcgggactcg   120
agcactagcc ccggggacta tgtgctcagc gtctccgaga actcgcgcgt ctcccactac   180
atcatcaaca gcagcggccc gcgcccgccg gtgccaccgt cgcccgccca gcctccgccc   240
ggggtgagtc cctccagact ccgaatagga gatcaagaat ttgattcatt gcctgcttta   300
ctggaattct acaaaatca ctatttggac actacaacgt tgatagaacc agtttccaga   360
tccaggcagg gtagtggagt gattctcagg caggaagagg cagagtatgt acgagccctc   420
tttgacttta tgggaatga tgaagaagat cttcccttta agaaaggaga catcctgaga   480
atccgggata agcctgaaga gcagtggtgg aatgcggagg acagcgaagg caagagaggg   540
atgattccag tcccttacgt ggagaagtat agacctgcct ccgcctcagt atcggctctg   600
attggaggtc ggtga                                                     615
```

SEQ ID NO: 97 *Bos taurus* (cow) CRK proto-oncogene, adaptor protein (CRK) amino acid sequence (NP_001179263)

```
MAGNFDSEER SSWYWGRLSR QEAVALLQGQ RHGVFLVRDS STSPGDYVLS VSENSRVSHY    60
IINSSGPRPP VPPSPAQPPP GVSPSRLRIG DQEFDSLPAL LEFYKIHYLD TTTLIEPVSK   120
```

TABLE 2-continued

```
SRQGSGVILR QEEAEYVRAL FDFNGNDEED LPFKKGDILR IRDKPEEQWW NAEDSEGKRG    180
MIPVPYVEKY RPASASVSAL IGGNQEGSHP QPLGGPEPGP YAQPSVNTPL PNLQNGPIYA    240
RVIQKRVPNA YDKTALALEV GELVKVTKIN VSGQWEGECN GKRGHFPFTH VRLLDQQNPD    300
EDFS                                                                 304
```

SEQ ID NO: 98 *Bos taurus* (cow) CRK proto-oncogene, adaptor protein
(CRK) amino acid sequence, isoform X1 (XP_005220152)

```
MAGNFDSEER SSWYWGRLSR QEAVALLQGQ RHGVFLVRDS STSPGDYVLS VSENSRVSHY     60
IINSSGPRPP VPPSPAQPPP GVSPSRLRIG DQEFDSLPAL LEFYKIHYLD TTTLIEPVSK    120
SRQGSGVILR QEEAEYVRAL FDFNGNDEED LPFKKGDILR IRDKPEEQWW NAEDSEGKRG    180
MIPVPYVEKY RPASASVSAL IGGR                                           204
```

SEQ ID NO: 99 *Mus musculus* CRK proto-oncogene, adaptor protein (CRK)
cDNA, transcript variant X1 (XM_006532124)

```
atggcgggca acttcgactc ggaggagcgg agtagctggt actggggccg cctgagccgg     60
caggaggcgg tggcgctatt gcagggccag cggcacgggg tgttcctggt gcgggactcg    120
agcaccagcc ccggggacta tgtgcttagc gtctccgaaa actcgcgcgt ctcccactac    180
atcatcaaca gcagcggccc gcgccctcca gtgcctccgt cgcccgctca gcctccgccg    240
ggagtgagtc cctccaggct ccgaatagga gatcaagaat ttgattcatt gcctgcttta    300
ctggaattct acaaaataca ctatttggac actacaacat tgatagaacc agtggccaga    360
tcaaggcagg gtagtggagt gattctcagg caggaggagg cagagtatgt gcgggccctc    420
tttgactta atgggaatga tgaagaagat cttcccttta agaaggaga catcctgaga      480
atccgggata agcctgaaga gcagtggtgg aatgcagagg acagcgaagg aaagaggggg    540
atgattcctg tcccttacgt ggagaagtat agacctgcct ccgcctcagt atcggctctg    600
attggaggta accaggaggg ttcccaccca cagccactgg gtgggccgga gcctgggccc    660
tatgcccaac ccagcgtcaa cactccgctc cctaacctcc agaatgggcc catttatgcc    720
agggttatcc agaagcgagt ccctaatgcc tacgacaaga cagccttggc tttggagctc    780
ctgatggttt ga                                                        792
```

SEQ ID NO: 100 *Mus musculus* CRK proto-oncogene, adaptor protein (CRK)
cDNA, transcript variant X2 (XM_006532125)

```
atggcgggca acttcgactc ggaggagcgg agtagctggt actggggccg cctgagccgg     60
caggaggcgg tggcgctatt gcagggccag cggcacgggg tgttcctggt gcgggactcg    120
agcaccagcc ccggggacta tgtgcttagc gtctccgaaa actcgcgcgt ctcccactac    180
atcatcaaca gcagcggccc gcgccctcca gtgcctccgt cgcccgctca gcctccgccg    240
ggagtgagtc cctccaggct ccgaatagga gatcaagaat ttgattcatt gcctgcttta    300
ctggaattct acaaaataca ctatttggac actacaacat tgatagaacc agtggccaga    360
tcaaggcagg gtagtggagt gattctcagg caggaggagg cagagtatgt gcgggccctc    420
tttgactta atgggaatga tgaagaagat cttcccttta agaaggaga catcctgaga      480
atccgggata agcctgaaga gcagtggtgg aatgcagagg acagcgaagg aaagaggggg    540
atgattcctg tcccttacgt ggagaagtat agacctgcct ccgcctcagt atcggctctg    600
attggagctc tgatggttt gatctctcta ctaaggactt acgagtttaa aaagcaaatt     660
ttatatttaa gatactgttc ttcttgggct ggacagatgg ctcagcggtt aagagcattg    720
actgctcttc cgaaggccct gagttcaaat cccagcaacc acatggtggc tcacaaccat    780
ctgtaa                                                               786
```

SEQ ID NO: 101 *Mus musculus* CRK proto-oncogene, adaptor protein (CRK)
cDNA, transcript variant 1 (NM_001277219)

```
atggcgggca acttcgactc ggaggagcgg agtagctggt actggggccg cctgagccgg     60
caggaggcgg tggcgctatt gcagggccag cggcacgggg tgttcctggt gcgggactcg    120
agcaccagcc ccggggacta tgtgcttagc gtctccgaaa actcgcgcgt ctcccactac    180
atcatcaaca gcagcggccc gcgccctcca gtgcctccgt cgcccgctca gcctccgccg    240
ggagtgagtc cctccaggct ccgaatagga gatcaagaat ttgattcatt gcctgcttta    300
ctggaattct acaaaataca ctatttggac actacaacat tgatagaacc agtggccaga    360
tcaaggcagg gtagtggagt gattctcagg caggaggagg cagagtatgt gcgggccctc    420
tttgactta atgggaatga tgaagaagat cttcccttta agaaggaga catcctgaga      480
atccgggata agcctgaaga gcagtggtgg aatgcagagg acagcgaagg aaagaggggg    540
atgattcctg tcccttacgt ggagaagtat agacctgcct ccgcctcagt atcggctctg    600
attggaggtc ggtga                                                     615
```

SEQ ID NO: 102 *Mus musculus* CRK proto-oncogene, adaptor protein (CRK)
cDNA, transcript variant 2 (NM_133656)

```
atggcgggca acttcgactc ggaggagcgg agtagctggt actggggccg cctgagccgg     60
caggaggcgg tggcgctatt gcagggccag cggcacgggg tgttcctggt gcgggactcg    120
agcaccagcc ccggggacta tgtgcttagc gtctccgaaa actcgcgcgt ctcccactac    180
atcatcaaca gcagcggccc gcgccctcca gtgcctccgt cgcccgctca gcctccgccg    240
ggagtgagtc cctccaggct ccgaatagga gatcaagaat ttgattcatt gcctgcttta    300
ctggaattct acaaaataca ctatttggac actacaacat tgatagaacc agtggccaga    360
tcaaggcagg gtagtggagt gattctcagg caggaggagg cagagtatgt gcgggccctc    420
tttgactta atgggaatga tgaagaagat cttcccttta agaaggaga catcctgaga      480
atccgggata agcctgaaga gcagtggtgg aatgcagagg acagcgaagg aaagaggggg    540
atgattcctg tcccttacgt ggagaagtat agacctgcct ccgcctcagt atcggctctg    600
attggaggta accaggaggg ttcccaccca gccactgg gtgggccgga gcctgggccc     660
tatgcccaac ccagcgtcaa cactccgctc cctaacctcc agaatgggcc catttatgcc    720
agggttatcc agaagcgagt ccctaatgcc tacgacaaga cagccttggc tttggaggtc    780
```

TABLE 2-continued

```
ggtgagctgg taaaggttac gaagattaat gtgagtggtc agtgggaagg ggagtgtaat      840
ggcaaacgag gtcacttccc attcacacat gtccgtctgc tggatcaaca gaatcccgat      900
gaggacttca gctga                                                      915
```

SEQ ID NO: 103 *Mus musculus* CRK proto-oncogene, adaptor protein (CRK) cDNA, transcript variant 3 (NM_001277221)

```
atggcgggca acttcgactc ggaggagcgg agtagctggt actggggccg cctgagccgg       60
caggaggcgg tggcgctatt gcagggccag cggcacgggg tgttcctggt gcgggactcg      120
agcaccagcc ccggggacta tgtgcttagc gtctccgaaa actcgcgcgt ctcccactac      180
atcatcaaca gcagcggccc gcgccctcca gtgcctccgt cgcccgctca gcctccgccg      240
ggtcggtga                                                             249
```

SEQ ID NO: 104 *Mus musculus* CRK proto-oncogene, adaptor protein (CRK) amino acid sequence, isoform X1 (XP_006532187)

```
MAGNFDSEER SSWYWGRLSR QEAVALLQGQ RHGVFLVRDS STSPGDYVLS VSENSRVSHY       60
IINSSGPRPP VPPSPAQPPP GVSPSRLRIG DQEFDSLPAL LEFYKIHYLD TTTLIEPVAR      120
SRQGSGVILR QEEAEYVRAL FDFNGNDEED LPFKKGDILR IRDKPEEQWW NAEDSEGKRG      180
MIPVPYVEKY RPASASVSAL IGGNQEGSHP QPLGGPEPGP YAQPSVNTPL PNLQNGPIYA      240
RVIQKRVPNA YDKTALALEL LMV                                             263
```

SEQ ID NO: 105 *Mus musculus* CRK proto-oncogene, adaptor protein (CRK) amino acid sequence, isoform X2 (XP_006532188)

```
MAGNFDSEER SSWYWGRLSR QEAVALLQGQ RHGVFLVRDS STSPGDYVLS VSENSRVSHY       60
IINSSGPRPP VPPSPAQPPP GVSPSRLRIG DQEFDSLPAL LEFYKIHYLD TTTLIEPVAR      120
SRQGSGVILR QEEAEYVRAL FDFNGNDEED LPFKKGDILR IRDKPEEQWW NAEDSEGKRG      180
MIPVPYVEKY RPASASVSAL IGAPDGLISL LRTYEFKKQI LYLRYCSSWA GQMAQRLRAL      240
TALPKALSSN PSNHMVAHNH L                                               261
```

SEQ ID NO: 106 *Mus musculus* CRK proto-oncogene, adaptor protein (CRK) amino acid sequence, isoform 1 (NP_001264148)

```
MAGNFDSEER SSWYWGRLSR QEAVALLQGQ RHGVFLVRDS STSPGDYVLS VSENSRVSHY       60
IINSSGPRPP VPPSPAQPPP GVSPSRLRIG DQEFDSLPAL LEFYKIHYLD TTTLIEPVAR      120
SRQGSGVILR QEEAEYVRAL FDFNGNDEED LPFKKGDILR IRDKPEEQWW NAEDSEGKRG      180
MIPVPYVEKY RPASASVSAL IGGR                                            204
```

SEQ ID NO: 107 *Mus musculus* CRK proto-oncogene, adaptor protein (CRK) amino acid sequence, isoform 2 (NP_598417)

```
MAGNFDSEER SSWYWGRLSR QEAVALLQGQ RHGVFLVRDS STSPGDYVLS VSENSRVSHY       60
IINSSGPRPP VPPSPAQPPP GVSPSRLRIG DQEFDSLPAL LEFYKIHYLD TTTLIEPVAR      120
SRQGSGVILR QEEAEYVRAL FDFNGNDEED LPFKKGDILR IRDKPEEQWW NAEDSEGKRG      180
MIPVPYVEKY RPASASVSAL IGGNQEGSHP QPLGGPEPGP YAQPSVNTPL PNLQNGPIYA      240
RVIQKRVPNA YDKTALALEV GELVKVTKIN VSGQWEGECN GKRGHFPFTH VRLLDQQNPD      300
EDFS                                                                  304
```

SEQ ID NO: 108 *Mus musculus* CRK proto-oncogene, adaptor protein (CRK) amino acid sequence, isoform 3 (NP_001264150)

```
MAGNFDSEER SSWYWGRLSR QEAVALLQGQ RHGVFLVRDS STSPGDYVLS VSENSRVSHY       60
IINSSGPRPP VPPSPAQPPP GR                                               82
```

SEQ ID NO: 109 *Rattus norvegicus* (rat) CRK proto-oncogene, adaptor protein (CRK) cDNA (NM_019302)

```
atggcaggca acttcgactc ggaggagcgg agtagctggt actggggccg cttgagccgg       60
caggaggcgg tggcgctatt gcagggccag cggcacgggg ttttcctggt gcgggactcg      120
agcaccagcc ccggggacta tgtgctcagc gtctccgaaa actcgcgcgt ctcccactac      180
atcatcaaca gcagcggccc gcgccctcca gtgcctccgt cgcccgctca gcctccgccg      240
ggagtgagtc cctccaggct ccgaatagga gatcaagaat ttgattcatt gcctgctcta      300
ctggaattct acaaaataca ctatttggac actacaacac tgatagaacc agtttccaga      360
tcaaggcagg gtagtggagt gattctcagg caggaggagg cagagtatgt gcgggccctc      420
tttgacttta tgggaatga tgaagaagat cttccccttta agaaggaga catcctgaga       480
atccgggata agcctgaaga gcagtggtgg aatgcagagg acagcgaagg aaagaggggg      540
atgattcctg tcccttacgt ggagaagtat agacccgcct ccgcctcagt atcggctctg      600
attggaggta accaggaggg ttcccaccca cagccactgg gtgggccgga gcctgggccc      660
tatgcccaac ccagcgtcaa cactccgctc cctaacctcc agaatgggcc catttatgcc      720
agggttatcc agaagcgagt ccctaatgcc tacgacaagg cccttggc tttgaggtc         780
ggtgagctgg taaaggttac gaagattaat gtgagtggtc agtgggaagg ggagtgtaat      840
ggcaaacgag gtcacttccc attcacacat gtccgtctgc tggatcaaca gaatcccgag      900
gaggacttca gctga                                                      915
```

SEQ ID NO: 110 *Rattus norvegicus* (rat) CRK proto-oncogene, adaptor protein (CRK) cDNA, transcript variant X1 (XM_006246913)

```
atggcaggca acttcgactc ggaggagcgg agtagctggt actggggccg cttgagccgg       60
caggaggcgg tggcgctatt gcagggccag cggcacgggg ttttcctggt gcgggactcg      120
```

TABLE 2-continued

```
agcaccagcc ccggggacta tgtgctcagc gtctccgaaa actgcgcgct ctcccactac    180
atcatcaaca gcagcggccc gcgcctcca gtgcctccgt cgcccgctca gcctccgccg    240
ggagtgagtc cctccaggct ccgaatagga gatcaagaat ttgattcatt gcctgcttta   300
ctggaattct acaaaataca ctatttggac actacaacac tgatagaacc agtttccaga   360
tcaaggcagg gtagtggagt gattctcagg caggaggagg cagagtatgt gcgggccctc   420
tttgactttta atgggaatga tgaagaagat cttcccttta agaaggaga catcctgaga   480
atccgggata agcctgaaga gcagtggtgg aatgcagagg acagcgaagg aaagaggggg   540
atgattcctg tcccttacgt ggagaagtat agacccgcct ccgcctcagt atcggctctg   600
attggaggtc ggtga                                                    615
```

SEQ ID NO: 111 *Rattus norvegicus* (rat) CRK proto-oncogene, adaptor
protein (CRK) amino acid sequence (NP_062175)

```
MAGNFDSEER SSWYWGRLSR QEAVALLQGQ RHGVFLVRDS STSPGDYVLS VSENSRVSHY    60
IINSSGPRPP VPPSPAQPPP GVSPSRLRIG DQEFDSLPAL LEFYKIHYLD TTTLIEPVSR   120
SRQGSGVILR QEEAEYVRAL FDFNGNDEED LPFKKGDILR IRDKPEEQWW NAEDSEGKRG   180
MIPVPYVEKY RPASASVSAL IGGNQEGSHP QPLGGPEPGP YAQPSVNTPL PNLQNGPIYA   240
RVIQKRVPNA YDKTALALEV GELVKVTKIN VSGQWEGECN GKRGHFPFTH VRLLDQQNPE   300
EDFS                                                                304
```

SEQ ID NO: 112 *Rattus norvegicus* (rat) CRK proto-oncogene, adaptor
protein (CRK) amino acid sequence, isoform X1 (XP_006246975)

```
MAGNFDSEER SSWYWGRLSR QEAVALLQGQ RHGVFLVRDS STSPGDYVLS VSENSRVSHY    60
IINSSGPRPP VPPSPAQPPP GVSPSRLRIG DQEFDSLPAL LEFYKIHYLD TTTLIEPVSR   120
SRQGSGVILR QEEAEYVRAL FDFNGNDEED LPFKKGDILR IRDKPEEQWW NAEDSEGKRG   180
MIPVPYVEKY RPASASVSAL IGGR                                          204
```

SEQ ID NO: 113 *Gallus gallus* (chicken) CRK proto-oncogene, adaptor
protein (CRK) cDNA (NM_001007846)

```
atggccgggc agttcgactc cgaggaccgg gggagctggt actgggggcg gctgagccgg    60
ggcgacgcgg tgtcgctgct gcaggggcaa cgccacggga ccttcctggt gcgcgactcg   120
ggctccatcc ccggcgactt cgtgctctcg gtgtccgaga gctcccgcgt ctcgcactac   180
atcgtcaaca gcctggggcc ggcgggaggc cggagggcg gcggcgaggg ccctgggggcc   240
ccggggttga atcccaccag atttcgaata ggtgaccagg agtttgattc tttgccatct   300
ttactggaat tctacaaaat acactatttg gacactacaa ccttgataga accagtttcc   360
cgatccaggc agaacagtgg cgttatcctc aggcaggagg aagttgaata tgtgcgagct   420
ctcttttgact ttaatggaaa cgatgacgaa gatcttccat ttaagaaagg agacatactg   480
aaaatccggg ataaacctga agagcaatgg tggaatgcag aagacatgga tggaaagagg   540
ggaatgatac ctgttcctta cgtcgagaag tgtagacctt cctctgcttc agtatctact   600
ctgactggag gtaaccagga tagttcccac ccacaaccac tgggtgggcc ggagccaggg   660
ccctatgccc agcccagcat caacactccg ctccctaacc ttcagaatgg cccttttat    720
gcccgggtta tccagaagcg agtccctaat gcctacgaca agacagcctt ggctttggag   780
gtcggtgagc tggtaaaggt cacgaagatt aacatgagtg gtcagtggga aggagaatgt   840
aatggcaaac gtggtcactt tccattcaca catgtccgcc tgctggatca acagaatcct   900
gatgaggact tcagctga                                                 918
```

SEQ ID NO: 114 *Gallus gallus* (chicken) CRK proto-oncogene, adaptor
protein (CRK) amino acid sequence (NP_001007847)

```
MAGQFDSEDR GSWYWGRLSR GDAVSLLQGQ RHGTFLVRDS GSIPGDFVLS VSESSRVSHY    60
IVNSLGPAGG RRAGGEGPGA PGLNPTRFRI GDQEFDSLPS LLEFYKIHYL DTTTLIEPVS   120
RSRQNSGVIL RQEEVEYVRA LFDFNGNDDE DLPFKKGDIL KIRDKPEEQW WNAEDMDGKR   180
GMIPVPYVEK CRPSSASVST LTGGNQDSSH PQPLGGPEPG PYAQPSINTP LPNLQNGPFY   240
ARVIQKRVPN AYDKTALALE VGELVKVTKI NMSGQWEGEC NGKRGHFPFT HVRLLDQQNP   300
DEDFS                                                               305
```

SEQ ID NO: 115 *Xenopus tropicalis* (frog) CRK proto-oncogene, adaptor
protein (CRK) cDNA (NM_001006107)

```
atggcgggca acttcgactc cgaggaccgg gcgagctggt actggggcaa gctgaacaga    60
caagaggcgg tcaatcttct gcagggccag cggcacggtg tgtttttagt tcgagactcc   120
acaactatac ctggtgacta cgtattgtct gtctctgaga actccaaggt ttcccactat   180
atcatcaaca gcgtcagcaa caaccggcag agtgggactg aatgatcca gtcccgattc   240
agaataggtc accaagagtt tgattcctta ccatctcctt tggaattta taagatccat   300
tacctggaca ctacaacttt aatagaacca gtttccaagt ctaaacaatc tggtgtaatc   360
caaagacaag aagaagttga atacgtgcga gctctctttg actttaatgg caatgatgat   420
gaagatcttc catttaagaa aggagacatc ctgagaattc gagataagcc cgaggagcag   480
tggtggaatg ctgaggacac cgatggaaga cggggcatga tacctgtgcc ttacgtcgag   540
aagtacaggc ctccctcttc agcagggtca gccctgattg gaggtaacca ggaaaactcg   600
caccccgaac cactgggtgg gccgagcca gggccctatg cccagcccag cgtcaacact   660
ccgctgccta accttcagaa tgggcccatt tttgccaggg ttatcagaa gcgcgtccct   720
aatgcctacg acaagacagc cttggctttg gaggttggtg atctagtaaa ggtaacaaag   780
attaatgtca gtggccagtg ggaaggagag tgcaacggga aatatggtca ttttccattt   840
acacatgtgc gtctgctgga tcaacagaac ccagaggagg actttagctg a            891
```

TABLE 2-continued

SEQ ID NO: 116 *Xenopus tropicalis* (frog) CRK proto-oncogene, adaptor
protein (CRK) cDNA, transcript variant X1 (XM_012956700)

```
atggcgggca acttcgactc cgaggaccgg gcgagctggt actggggcaa gctgaacaga    60
caagaggcgg tcaatcttct gcaggggcag cggcacggtg tgtttttagt tcgagactcc   120
acaactatac ctggtgacta cgtattgtct gtctctgaga actccaaggt ttcccactat   180
atcatcaaca gcgtcagcaa caaccggcag agtgggactg gaatgatcca gtcccgattc   240
agaataggtg accaagagtt tgattcctta ccatctcttt tggaatttta taagatacat   300
tacctggaca ctacaacttt aatagaacca gtttccaagt ctaaacaatc tggtgtaatc   360
caaagacaag aagaagttga atacgtgcga gctctctttg actttaatgg caatgatgat   420
gaagatcttc catttaagaa aggagacatc ctgagaattc gagataagcc cgaggagcag   480
tggtggaatg ctgaggacaa cgatggaaga cggggcatga tacctgtgcc ttacgtcgag   540
aagtacaggc ctcccctctt cagcagggtca gccctgattg gaggttggtg a           591
```

SEQ ID NO: 117 *Xenopus tropicalis* (frog) CRK proto-oncogene, adaptor
protein (CRK) amino acid sequence (NP_001006107)

```
MAGNFDSEDR ASWYWGKLNR QEAVNLLQGQ RHGVFLVRDS TTIPGDYVLS VSENSKVSHY    60
IINSVSNNRQ SGTGMIQSRF RIGDQEFDSL PSLLEFYKIH YLDTTTLIEP VSKSKQSGVI   120
QRQEEVEYVR ALFDFNGNDD EDLPFKKGDI LRIRDKPEEQ WWNAEDNDGR RGMIPVPYVE   180
KYRPPSSAGS ALIGGNQENS HPQPLGGPEP GPYAQPSVNT PLPNLQNGPI FARVIQKRVP   240
NAYDKTALAL EVGDLVKVTK INVSGQWEGE CNGKYGHPPF THVRLLDQQN PEEDFS       296
```

SEQ ID NO: 118 *Xenopus tropicalis* (frog) CRK proto-oncogene, adaptor
protein (CRK) amino acid sequence, isoform X1 (XP_012812154)

```
MAGNFDSEDR ASWYWGKLNR QEAVNLLQGQ RHGVFLVRDS TTIPGDYVLS VSENSKVSHY    60
IINSVSNNRQ SGTGMIQSRF RIGDQEFDSL PSLLEFYKIH YLDTTTLIEP VSKSKQSGVI   120
QRQEEVEYVR ALFDFNGNDD EDLPFKKGDI LRIRDKPEEQ WWNAEDNDGR RGMIPVPYVE   180
KYRPPSSAGS ALIGGW                                                   196
```

SEQ ID NO: 119 *Homo Sapiens* killer cell lectin-like receptor
subfamily F member 1 (KLRF1) cDNA sequence, transcript variant
KLRF1-s3 (NM_001291823.1)

```
atgcaagatg aagaaagata catgacattg aatgtacagt caaagaaaag gagttctgcc    60
caaacatctc aacttacatt taaagattat tcagtgacgt tgcactggta taaaatctta   120
ctgggaatat ctggaaccgt gaatggtatt ctcactttga ctttgatctc cttgatcctg   180
ttggattctt cataa                                                    195
```

SEQ ID NO: 120 *Homo Sapiens* killer cell lectin-like receptor
subfamily F member 1 (KLRF1) cDNA sequence, transcript variant
KLRF1-s (NM_001291822.1)

```
atgcaagatg aagaaagata catgacattg aatgtacagt caaagaaaag gagttctgcc    60
caaacatctc aacttacatt taaagattat tcagtgacgt tgcactggta taaaatctta   120
ctgggaatat ctggaaccgt gaatggtatt ctcactttga ctttgatctc cttgatcctg   180
ttggtactat gccaatcaga atggctcaaa taccaaggga agtgttattg gttctctaat   240
gagatgaaaa gctggagtga cagttatgtg tattgtttgg aaagaaaatc tcatctacta   300
atcatacatg accaacttga aatggctttt atacagaaaa acctaagaca attaaactac   360
gtatggattg gcttaacttt tacctccttg aaaatgacat ggacttgggt ggatggttct   420
ccaatagatt caaagatatt cttcataaag ggaccagcta agaaaacag ctgtgctgcc    480
attaaggaaa gcaaaatttt ctctgaaacc tgcagcagtg ttttcaaatg gatttgtcag   540
tattag                                                             546
```

SEQ ID NO: 121 *Homo Sapiens* killer cell lectin-like receptor
subfamily F member 1 (KLRF1) cDNA sequence, transcript variant
1 (NM_016523.2)

```
atgcaagatg aagaaagata catgacattg aatgtacagt caaagaaaag gagttctgcc    60
caaacatctc aacttacatt taaagattat tcagtgacgt tgcactggta taaaatctta   120
ctgggaatat ctggaaccgt gaatggtatt ctcactttga ctttgatctc cttgatcctg   180
ttggtttctc agggagtatt gctaaaatgc caaaaggaa gttgttcaaa tgccactcag   240
tatgaggaca ctggagatct aaaagtgaat aatggcacaa gaagaaatat aagtaataag   300
gacctttgtg cttcgagatc tgcagaccag acagtactat gccaatcaga atggctcaaa   360
taccaaggga agtgttattg gttctctaat gagatgaaaa gctggagtga cagttatgtg   420
tattgtttgg aaagaaaatc tcatctacta atcatacatg accaacttga aatggctttt   480
atacagaaaa acctaagaca attaaactac gtatggattg gcttaacttt tacctccttg   540
aaaatgacat ggacttgggt ggatggttct ccaatagatt caaagatatt cttcataaag   600
ggaccagcta agaaaaacag ctgtgctgcc attaaggaaa gcaaaatttt ctctgaaacc   660
tgcagcagtg ttttcaaatg gatttgtcag tattag                             696
```

TABLE 2-continued

SEQ ID NO: 122 Homo Sapiens killer cell lectin-like receptor subfamily F member 1 (KLRF1) amino acid sequence, isoform 1 (NP_057607.1)

```
MQDEERYMTL NVQSKKRSSA QTSQLTFKDY SVTLHWYKIL LGISGIVNGI LTLTLISLIL    60
LVSQGVLLKC QKGSCSNATQ YEDTGDLKVN NGTRRNISNK DLCASRSADQ TVLCQSEWLK   120
YQGKCYWFSN EMKSWSDSYV YCLERKSHLL IIHDQLEMAF IQKNLRQLNY VWIGLNFTSL   180
KMTWTWVDGS PIDSKIFFIK GPAKENSCAA IKESKIFSET CSSVFKWICQ Y            231
```

SEQ ID NO: 123 Homo Sapiens killer cell lectin-like receptor subfamily F member 1 (KLRF1) amino acid sequence, isoform s3 (NP_001278752.1)

```
MQDEERYMTL NVQSKKRSSA QTSQLTFKDY SVTLHWYKIL LGISGTVNGI LTLTLISLIL    60
LDSS                                                                  64
```

SEQ ID NO: 124 Homo Sapiens killer cell lectin-like receptor subfamily F member 1 (KLRF1) amino acid sequence, isoform s (NP_001278751.1)

```
MQDEERYMTL NVQSKKRSSA QTSQLTFKDY SVTLHWYKIL LGISGTVNGI LTLTLISLIL    60
LVLCQSEWLK YQGKCYWFSN EMKSWSDSYV YCLERKSHLL IIHDQLEMAF IQKNLRQLNY   120
VWIGLNFTSL KMTWTWVDGS PIDSKIFFIK GPAKENSCAA IKESKIFSET CSSVFKWICQ   180
Y                                                                   181
```

SEQ ID NO: 125 Homo Sapiens Serine/Threonine Kinase 33 (STK33) cDNA sequence, transcript variant 1 (NM_030906.3)

```
atggctgata gtggcttaga taaaaaatcc acaaaatgcc ccgactgttc atctgcttct     60
cagaaagatg tactttgtgt atgttccagc aaaacaaggg ttcctccagt tttggtggtg   120
gaaatgtcac agacatcaag cattggtagt gcagaatctt aatttcact ggagagaaaa    180
aaagaaaaaa atatcaacag agatataacc tccaggaaag atttgccctc aagaacctca   240
aatgtagaga gaaaagcatc tcagcaacaa tggggtcggg gcaactttac agaaggaaaa   300
gttcctcaca taaggattga aatggagct gctattgagg aaatctatac ctttggaaga    360
atattgggaa aagggagctt tggaatagtc attgaagcga cagacaagga aacagaaacg   420
aagtgggcaa ttaaaaaagt gaacaaagaa aaggctggaa gctctgctgt gaagttactt   480
gaacgagagg tgaacattct gaaaagtgta aaacatgaac acatcataca tctggaacaa   540
gtatttgaaa cgccaaagaa aatgtaccat gtgatggagc tttgtgagga tggagaactc   600
aaagaaattc tggataggaa agggcatttt cagagaatg agacaaggtg gatcattcaa    660
agtctcgcat cagctatagc atatcttcac aataatgata ttgtacatag agatctgaaa   720
ctggaaacat taatggttaa aagcagtctt attgatgata aaaatgaaat aaaacttaaac  780
ataaaggtga ctgattttgg cttagccggtg aagaagcaaa gtaggagtga agccatgctg   840
caggccacat gtgggactcc tatctatatg gcccctgaag ttatcagtgc ccacgactat   900
agccagcagt gtgacatttg gagcataggc gtcgtaatgt acatgttat acgtggagaa    960
ccaccctttt tggcaagctc agaagagaag ctttttgagt taataagaag aggagaacta  1020
cattttgaaa atgcagtctg gaattccata agtgactgtg ctaaaagtgt tttgaaacaa   1080
cttatgaaag tagatcctgc tcacagaatc acagctaagg aactactaga taaccagtgg  1140
ttaacaggca ataaacttc ttcggtgaga ccaaccaatg tattagagat gatgaaggaa   1200
tggaaaaata acccagaaag tgttgaggaa aacacaacag aagaagaa taagccgtcc    1260
actgaagaaa agttgaaaag ttaccaaccc tggggaaatg tccctgatgc caattacact   1320
tcagatgaag aggaggaaaa acagtctact gctatgaaaa agcaatttcc tgcaaccagt   1380
aaggacaact ttgatatgtg cagttcaagt ttcacatcta gcaaactcct tccagctgaa   1440
atcaaggagg aaatggagaa aaccctgtgt actccaagcc aaggaacagc aaccaagtac   1500
cctgctaaat ccggcgcct gtccagaacc aaaaagaaac tctaa                    1545
```

SEQ ID NO: 126 Homo Sapiens Serine/Threonine Kinase 33 (STK33) cDNA sequence, transcript variant 2 (NM_001289058.1)

```
atgtcacaga catcaagcat tggtagtgca gaatctttaa tttcactgga gagaaaaaaa     60
gaaaaaaata tcaacagaga tataacctcc aggaaagatt tgccctcaag aacctcaaat   120
gtagagagaa aagcatctca gcaacaatgg gtcggggca actttacaga aggaaaagtt   180
cctcacataa ggattgagaa tggagctgct attgaggaaa tctataccttt tggaagaata  240
ttgggaaaag ggagctttgg aatagtcatt gaagcgacac acaaggaaac agaaacgaag  300
tgggcaatta aaaagtgaa caaagaaaag gctggaagct ctgctgtgaa gttacttgaa    360
cgagaggtga acattctgaa aagtgtaaaa catgaacaca tcatacatct ggaacaagta  420
tttgaaacgc caaagaaat gtaccttgtg atggagcttt gtgaggatgg agaactcaaa   480
gaaattctgg ataggaaagg gcatttctca gagaatgaga caaggtggat cattcaaagt   540
ctcgcatcag ctatagcata tcttcacaat aatgatattg tacatagaga tctgaaactg   600
gaaaatataa tggttaaaag cagtcttatt gatgataaca atgaaataaa cttaaacata   660
aaggtgactg attttggctt agcggtgaag aagcaaagtg gagtgaagc catgctgcag    720
gccacatgtg ggactcctat ctatatggcc cctgaagtta tcagtgccca cgactatagc   780
cagcagtgtg acatttggag cataggcgtc gtaatgtaca tgttattacg tggagaacca   840
ccctttttgg caagctcaga agaagcttt tgagttaa taagaaagg agaactacat      900
tttgaaaatg cagtctggaa ttccataagt gactgtgcta aaagtgtttt gaaacaactt   960
atgaaagtag atcctgctca cagaatcaca gctaaggaac tactagataa ccagtggtta  1020
acaggcaata aacttcttc ggtgagacca accaatgtat tagagatgat gaaggaatgg   1080
aaaaataacc cagaaagtgt tgaggaaaac acaacagaag aagaataa gccgtccact    1140
gaagaaaagt tgaaagtta ccaaccctgg ggaaatgtcc ctgatgccaa ttacacttca   1200
gatgaagagg aggaaaaaca gtctactgct atgaaaagc aatttcctgc aaccagtaag   1260
```

TABLE 2-continued

```
gacaactttg atatgtgcag ttcaagtttc acatctagca aactccttcc agctgaaatc   1320
aagggagaaa tggagaaaac ccctgtgact ccaagccaag gaacagcaac caagtaccct   1380
gctaaatccg gcgccctgtc cagaaccaaa aagaaactct aa                      1422
```

SEQ ID NO: 127 *Homo Sapiens* Serine/Threonine Kinase 33 (STK33) cDNA
sequence, transcript variant 3 (NM_001289059.1)

```
atgtaccttg tgatggagct tgtgaggat ggagaactca aagaaattct ggataggaaa    60
gggcatttct cagagaatga gacaaggtgg atcattcaaa gtctcgcatc agctatagca    120
tatcttcaca ataatgatat tgtacataga gatctgaaac tggaaaatat aatggttaaa    180
agcagtctta ttgatgataa caatgaaata aacttaaaca taaaggtgac tgattttggc    240
ttagcggtga agaagcaaag taggagtgaa gccatgctgc aggccacatg tgggactcct    300
atctatatgg cccctgaagt tatcagtgcc cacgactata gccagcagtg tgacatttgg    360
agcataggcg tcgtaatgta catgttatta cgtggagaa caccccttttt ggcaagctca    420
gaagagaagc tttttgagtt aataagaaaa ggagaactac attttgaaaa tgcagtctgg    480
aattccataa gtgactgtgc taaaagtgtt ttgaaacaac ttatgaaagt agatcctgct    540
cacagaatca cagctaagga actactagat aaccagtggt taacaggcaa taaactttct    600
tcggtgagac caaccaatgt attagagatg atgaaggaat ggaaaaataa cccagaaagt    660
gttgaggaaa acacaacaga agagaagaat aagccgtcca ctgaagaaaa gttgaaaagt    720
taccaacctt ggggaaatgt ccctgatgcc aattacactt cagatgaaga ggaggaaaaa    780
cagtctactg cttatgaaaa gcaatttcct gcaaccagta aggacaactt tgatatgtgc    840
agttcaagtt tcacatctag caaactcctt ccagctgaaa tcaagggaga aatggagaaa    900
accctgtga ctccaagcca aggaacagca accaagtacc ctgctaaatc cggcgccctg    960
tccagaacca aaaagaaact ctaa                                            984
```

SEQ ID NO: 128 *Homo Sapiens* Serine/Threonine Kinase 33 (STK33) cDNA
sequence, transcript variant 4 (NM_001289061.1)

```
atggctgata gtggcttaga taaaaaatcc acaaaatgcc ccgactgttc atctgcttct    60
cagaaagatg tactttgtgt atgttccagc aaaacagggt tcctccagt ttttggtggtg    120
gaaatgtcac agacatcaag cattggtagt gcagaatctt aatttcact ggagagaaaa    180
aaagaaaaaa atatcaacag agatataacc tccaggaaag atttgccctc aagaacctca    240
aatgtagaga gaaaagcatc tcagcaacaa tgggtcggg gcaactttac agaaggaaaa    300
gttcctcaca taaggattga gaatggagct gctattgaag aaatctatac ctttggaaga    360
atattgggaa aagggagctt tggaatagtc attgaagcga cagacaagga aacagaaacg    420
aagtgggcaa ttaaaaagt gaacaaagaa aaggctggaa gctctgctgt gaagttactt    480
gaacgagagg tgaacattct gaaaagtgta aaacatgaac acatcataca tctgaacaa    540
gtatttgaaa cgccaaagaa aatgtaccttt gtgatgagc tttgtgagga tggagaactc    600
aaagaaattc tggataggaa agggcatttc tcagagaatg agacaaggtg gatcattcaa    660
agtctcgcat cagctatagc atatcttcac aataatgata ttgtacatag agatctgaaa    720
ctggaaaata taatggttaa aagcagtctt attgatgata caatgaaat aaacttaaac    780
ataaaggtga ctgatttttgg cttagcggtg aagaagcaaa gtaggagtga agccatgctg    840
caggccacat gtgggactcc tatctatatg gcccctgaag ttatcagtgc ccacgactat    900
agccagcagt gtgacatttg gagcataggc gtcgtaatgt acatgttatt acgtggagaa    960
ccacccttttt tggcaagctc agaagagaag cttttttgagt taataagaaa aggagaacta   1020
cattttgaaa atgcagtctg gaattccata agtgactgtg ctaaaagtgt tttgaaacaa   1080
cttatgaaag tagatcctgc tcacagaatc acagctaagg aactactaga taaccagtgg   1140
ttaacaggca ataaactttc ttcggtgaga ccaaccaatg tattagagat gatgaaggaa   1200
tggaaaaata acccagaaag tgttgaggaa aacacaacag aagagaagaa taagccgtcc   1260
actgaagaaa agttgaaaag ttaccaaccc tggggaaatg tccctgatgc caattacact   1320
tcagatgaag aggaggaaaa acagtctact gcttatgaaa agcaatttcc tgcaaccagt   1380
aaggacaact ttgatatgtg cagttcaagt ttcacatcta gcaaactcct tccagctgaa   1440
atcaagggag aaatggagaa aaccctgtg actccaagcc aaggaacagc aaccaagtac   1500
cctgctaaat ccggcgccct gtccagaacc aaaaagaaac tctaa                    1545
```

SEQ ID NO: 129 *Homo Sapiens* Serine/Threonine Kinase 33 (STK33)
amino acid sequence, isoform a (NP_112168.1)

```
MADSGLDKKS TKCPDCSSAS QKDVLCVCSS KTRVPPVLVV EMSQTSSIGS AESLISLERK    60
KEKNINRDIT SRKDLPSRTS NVERKASQQQ WGRGNFTEGK VPHIRIENGA AIEEIYTFGR   120
ILGKGSFGIV IEATDKETET KWAIKKVNKE KAGSSAVKLL EREVNILKSV KHEHIIHLEQ   180
VFETPKKMYL VMELCEDGEL KEILDRKGHF SENETRWIIQ SLASAIAYLH NNDIVHRDLK   240
LENIMVKSSL IDDNNEINLN IKVTDFGLAV KKQSRSEAML QATCGTPIYM APEVISAHDY   300
SQQCDIWSIG VVMYMLLRGE PPFLASSEEK LFELIRKGEL HFENAVWNSI SDCAKSVLKQ   360
LMKVDPAHRI TAKELLDNQW LTGNKLSSVR PTNVLEMMKE WKNNPESVEE NTTEEKNKPS   420
TEEKLKSYQP WGNVPDANYT SDEEEEKQST AYEKQFPATS KDNFDMCSSS FTSSKLLPAE   480
IKGEMEKTPV TPSQGTATKY PAKSGALSRT KKKL                                514
```

SEQ ID NO: 130 *Homo Sapiens* Serine/Threonine Kinase 33 (STK33)
amino acid sequence, isoform a (NP_001275990.1)

```
MADSGLDKKS TKCPDCSSAS QKDVLCVCSS KTRVPPVLVV EMSQTSSIGS AESLISLERK    60
KEKNINRDIT SRKDLPSRTS NVERKASQQQ WGRGNFTEGK VPHIRIENGA AIEEIYTFGR   120
ILGKGSFGIV IEATDKETET KWAIKKVNKE KAGSSAVKLL EREVNILKSV KHEHIIHLEQ   180
VFETPKKMYL VMELCEDGEL KEILDRKGHF SENETRWIIQ SLASAIAYLH NNDIVHRDLK   240
LENIMVKSSL IDDNNEINLN IKVTDFGLAV KKQSRSEAML QATCGTPIYM APEVISAHDY   300
SQQCDIWSIG VVMYMLLRGE PPFLASSEEK LFELIRKGEL HFENAVWNSI SDCAKSVLKQ   360
LMKVDPAHRI TAKELLDNQW LTGNKLSSVR PTNVLEMMKE WKNNPESVEE NTTEEKNKPS   420
TEEKLKSYQP WGNVPDANYT SDEEEEKQST AYEKQFPATS KDNFDMCSSS FTSSKLLPAE   480
IKGEMEKTPV TPSQGTATKY PAKSGALSRT KKKL                                514
```

TABLE 2-continued

SEQ ID NO: 131 Homo Sapiens Serine/Threonine Kinase 33 (STK33) amino acid sequence, isoform c (NP_001275988.1)

```
MYLVMELCED GELKEILDRK GHFSENETRW IIQSLASAIA YLHNNDIVHR DLKLENIMVK    60
SSLIDDNNEI NLNIKVTDFG LAVKKQSRSE AMLQATCGTP IYMAPEVISA HDYSQQCDIW   120
SIGVVMYMLL RGEPPFLASS EEKLFELIRK GELHFENAVW NSISDCAKSV LKQLMKVDPA   180
HRITAKELLD NQWLTGNKLS SVRPTNVLEM MKEWKNNPES VEENTTEEKN KPSTEEKLKS   240
YQPWGNVPDA NYTSDEEEEK QSTAYEKQFP ATSKDNEDMC SSSFTSSKLL PAEIKGEMEK   300
TPVTPSQGTA TKYPAKSGAL SRTKKKL                                      327
```

SEQ ID NO: 132 Homo Sapiens Serine/Threonine Kinase 33 (STK33) amino acid sequence, isoform b (NP_001275987.1)

```
MSQTSSIGSA ESLISLERKK EKNINRDITS RKDLPSRTSN VERKASQQQW GRGNFTEGKV    60
PHIRIENGAA IEEIYTFGRI LGKGSFGIVI EATDKETETK WAIKKVNKEK AGSSAVKLLE   120
REVNILKSVK HEHIIHLEQV FETPKKMYLV MELCEDGELK EILDRKGHFS ENETRWIIQS   180
LASAIAYLHN NDIVHRDLKL ENIMVKSSLI DDNNEINLNI KVTDEGLAVK KQSRSEAMLQ   240
ATCGTPIYMA PEVISAHDYS QQCDIWSIGV VMYMLLRGEP PFLASSEEKL FELIRKGELH   300
FENAVWNSIS DCAKSVLKQL MKVDPAHRIT AKELLDNQWL TGNKLSSVRP TNVLEMMKEW   360
KNNPESVEEN TTEEKNKPST EEKLKSYQPW GNVPDANYTS DEEEEKQSTA YEKQFPATSK   420
DNFDMCSSSF TSSKLLPAEI KGEMEKTPVT PSQGTATKYP AKSGALSRTK KKL          473
```

SEQ ID NO: 133 Mouse Serine/Threonine Kinase 33 (STK33) cDNA sequence (NM_054103.1)

```
atggctgacc ccagcttgaa tgacaaccct acagcatgcc ctcactgtgc atcctctcag    60
gctggcctac tgtgtgtatg tccagcaggc aagtctccag tcctggtggt ggaaatgtca   120
cagacatcga gtattggtag tacagaattt tttgcttcac aagaaagaaa aaaggaaaga   180
aataccagca gagaatcttc tctaaaagat ttgtccataa gaacttcaaa tgtggagaga   240
aaacctcagg cacaatggag tcggagcaat gtcacagtag aaaaatccc acacataaga    300
atggacgatg gagcaggtat cgaggaattc tataccttg aagaatatt gggacagggg     360
agctttggaa tggtctttga agctatagac aaggaaacag gagctaagtg ggcaattaaa   420
aagtgaata agaaaaggc tggaagttct gcaatgaagc tactggagcg ggaggtgagc     480
atcctgaaga ctgtcaacca tcaacacatc atccacctgg aacaagtgtt tgagtcgcct   540
cagaaaatgt atctcgtgat ggagctttgt gaggatggag aactcaaagc agttatggat   600
caaagagggc acttctcaga aacgagaca aggctgataa ttcaaagtct tgcatcagcc    660
atcgcatatc ttcataacaa ggatatagtg cacagagatc taaagctgga aaacataagtg  720
gttaaaagca gctttataga tgataacaat gaaatgaact aaacataaa ggtgactgat    780
tttggcttgt ctgtgcagaa gcatggctcc aggagtgaag gcatgatgca gactacatgt   840
gggactccta tctatatggc accagaggtc atcaatgccc atgactacag ccagcagtgt   900
gacatttgga gcataggtgt cataatgttc atttactgt gtgggagagcc acccttttg    960
gcaaattcag aagaaaagct ctatgaatta ataaaaagg gagaactacg atttgaaaat   1020
ccagtctggg aatctgtaag tgattctgca aaaaatactt tgaaacaact catgaaagta  1080
gatcctgctc acagaatcac agctaaggaa cttctagata accaatggtt gacaggcaat  1140
acccttctt cagcaagacc aaccaatgta ttagaaatga aaaaaatac                1200
ccagaaagtg atgaggagac caacacagat gaggagactg agcagagcgc tgtctacagt  1260
ccatctgcaa acacagcaaa gcagcccacc aatgcagcca agaagcctgc tgcagagagt  1320
gttggcatga cctcttcaaa ctcatcgtcc agcaaactcc tgtctgctga agcaaagca    1380
gaaccagaga aaagctccga gactgtaggc catgcatcag tggctaaaac cactctgaaa  1440
tccactacct tgtttcgagg caagaaaagg ctctaa                             1476
```

SEQ ID NO: 134 Mouse Serine/Threonine Kinase 33 (STK33) amino acid sequence, isoform a ( )

```
MADPSLNDNP TACPHCASSQ AGLLCVCPAG KSPVLVVEMS QTSSIGSTEF FASQERKKER    60
NTSRESSLKD LSIRTSNVER KPQAQWSRSN VTVGKIPHIR MDDGAGIEEF YTFGRILGQG   120
SFGMVFEAID KETGAKWAIK KVNKEKAGSS AMKLLEREVS ILKTVNHQHI IHLEQVFESP   180
QKMYLVMELC EDGELKAVMD QRGHFSENET RLIIQSLASA IAYLHNKDIV HRDLKLENIM   240
VKSSFIDDNN EMNLNIKVTD FGLSVQKHGS RSEGMMQTTC GTPIYMAPEV INAHDYSQQC   300
DIWSIGVIMF ILLCGEPPFL ANSEEKLYEL IKKGELRFEN PVWESVSDSA KNTLKQLMKV   360
DPAHRITAKE LLDNQWLTGN TLSSARPTNV LEMMKEWKNN PESDEETNTD EETEQSAVYS   420
PSANTAKQPT NAAKKPAAES VGMTSSNSSS SKLLSAESKA EPEKSSETVG HASVAKTTLK   480
STTLFRGKKR L                                                        491
```

SEQ ID NO: 135 Human ephrin type-B receptor 2 (EPHB2) cDNA sequence, transcript variant 1 (NM_017449.4)

```
atggctctgc ggaggctggg ggccgcgctg ctgctgctgc cgctgctcgc cgccgtggaa    60
gaaacgctaa tggactccac tacagcgact gctgagctgg gctggatggt gcatcctcca   120
tcagggtggg aagaggtgag tggctacgat gagaacatga acacgatccg cacgtaccag   180
gtgtgcaacg tgtttgagtc aagccagaac aactggctac ggaccaagtt tatccgcgc    240
cgtggcgccc accgcatcca cgtggagatg aagtttttcgg tgcgtgactg cagcagcatc   300
cccagcgtgc ctggctcctg caaggagacc ttcaacctct attactatga ggctgacttt   360
gactcggcca ccaagacctt ccccaactgg atggagaatc catgggtgaa ggtggataca   420
attgcagccg acgagagctt ctcccaggtg gacctgggtg gccgcgtcat gaaaatcaac   480
accgaggtgc ggagctcgg acctgtgtcc cgcagcggct ctacctggc cttccaggac   540
tatgcgggct gcatgtccct catcgccgtg cgtgtcttct accgcaagtg ccccgcatc    600
atccagaatg gcgccatctt ccaggaaacc ctgtcgggg ctgagagcac atcgctggtg    660
gctgcccggg gcagctgcat cgccaatgcg gaagaggtgg atgtacccat caagctctac   720
```

TABLE 2-continued

| | | | | |
|---|---|---|---|---|
| tgtaacgggg | acggcgagtg | gctggtgccc | atcgggcgct | gcatgtgcaa agcaggcttc | 780 |
| gaggccgttg | agaatggcac | cgtctgccga | ggttgtccat | ctgggacttt caaggccaac | 840 |
| caaggggatg | aggcctgtac | ccactgtccc | atcaacagcc | ggaccacttc tgaaggggcc | 900 |
| accaactgtg | tctgccgcaa | tggctactac | agagcagacc | tggaccccct ggacatgccc | 960 |
| tgcacaacca | tcccctccgc | gccccaggct | gtgatttcca | gtgtcaatga gacctccctc | 1020 |
| atgctggagt | ggaccccctcc | ccgcgactcc | ggaggccgag | aggacctcgt ctacaacatc | 1080 |
| atctgcaaga | gctgtggctc | gggccggggt | gcctgcaccc | gctgcgggga caatgtacag | 1140 |
| tacgcaccac | gccagctagg | cctgaccgag | ccacgcattt | acatcagtga cctgctggcc | 1200 |
| cacacccagt | acaccttcga | gatccaggct | gtgaacggcg | ttactgacca gagcccttc | 1260 |
| tcgcctcagt | tcgcctctgt | gaacatcacc | accaaccagg | cagctccatc ggcagtgtcc | 1320 |
| atcatgcatc | aggtgagccg | caccgtggac | agcattaccc | tgtcgtggtc ccagccggac | 1380 |
| cagcccaatg | gcgtgatcct | ggactatgag | ctgcagtact | atgagaagga gctcagtgag | 1440 |
| tacaacgcca | cagccataaa | aagccccacc | aacacggtca | ccgtgcaggg cctcaaagcc | 1500 |
| ggcgccatct | atgtcttcca | ggtgcgggca | cgcaccgtgg | caggctacgg gcgctacagc | 1560 |
| ggcaagatgt | acttccagac | catgacagaa | gccgagtacc | agacaagcat ccaggagaag | 1620 |
| ttgccactca | tcatcggctc | ctcggccgct | ggcctggtct | tcctcattgc tgtggttgtc | 1680 |
| atcgccatcg | tgtgtaacag | acgggggttt | gagcgtgctg | actcggagta cacggacaag | 1740 |
| ctgcaacact | acaccagtgg | ccacatgacc | ccaggcatga | agatctacat cgatcctttc | 1800 |
| acctacgagg | accccaacga | ggcagtgcgg | gagtttgcca | aggaaattga catctcctgt | 1860 |
| gtcaaaattg | agcaggtgat | cggagcaggg | gagtttggcg | aggtctgcag tggccacctg | 1920 |
| aagctgccag | gcaagagaga | gatctttgtg | gccatcaaga | cgctcaagtc gggctacacg | 1980 |
| gagaagcagc | gccgggactt | cctgagcgaa | gcctccatca | tgggccagtt cgaccatccc | 2040 |
| aacgtcatcc | acctggaggg | tgtcgtgacc | aagagcacac | ctgtgatgat catcaccgag | 2100 |
| ttcatggaga | atggctccct | ggactccttt | ctccggcaaa | acgatgggca gttcacagtc | 2160 |
| atccagtggg | tgggcatgct | tcggggcatc | gcagctggca | tgaagtacct ggcagacatg | 2220 |
| aactatgttc | accgtgacct | ggctgcccgc | aacatcctcg | tcaacagcaa cctggtctgc | 2280 |
| aaggtgtcgg | actttgggct | ctcacgcttt | ctagaggacg | atacctcaga ccccacctac | 2340 |
| accagtgccc | tgggcggaaa | gatccccatc | cgctggacag | ccccgaaagc catccagtac | 2400 |
| cggaagttca | cctcggccag | tgatgtgtgg | agctacggca | ttgtcatgtg ggaggtgatg | 2460 |
| tcctatgggg | agcggcccta | ctgggacatg | accaaccagg | atgtaatcaa tgccattgag | 2520 |
| caggactatc | ggctgccacc | gcccatggac | tgcccgagcg | ccctgcacca actcatgctg | 2580 |
| gactgttggc | agaaggaccg | caaccaccgg | cccaagttcg | gccaaattgt caacacgcta | 2640 |
| gacaagatga | tccgcaatcc | caacagcctc | aaagccatgg | cgcccctctc ctctggcatc | 2700 |
| aacctgccgc | tgctggaccg | cacgatcccc | gactaccaca | gctttaacac ggtggacgag | 2760 |
| tggctggagg | ccatcaagat | ggggcagtac | aaggagagct | cgccaatgc cggcttcacc | 2820 |
| tcctttgacg | tcgtgtctca | gatgatgatg | gaggacattc | tccggggttgg ggtcactttg | 2880 |
| gctggccacc | agaaaaaaat | cctgaacagt | atccaggtga | tgcgggcgca gatgaaccag | 2940 |
| attcagtctg | tggaggtttg | a | | | 2961 |

SEQ ID NO: 136 Human ephrin type-B receptor 2 (EPHB2) cDNA sequence, transcript variant 2 (NM_004442.7)

| | | | | |
|---|---|---|---|---|
| atggctctgc | ggaggctggg | ggccgcgctg | ctgctgctgc | cgctgctcgc cgccgtggaa | 60 |
| gaaacgctaa | tggactccac | tacagcgact | gctgagctgg | gctggatggt gcatcctcca | 120 |
| tcagggtggg | aagaggtgag | tggctacgat | gagaacatga | acacgatccg cacgtaccag | 180 |
| gtgtgcaacg | tgtttgagtc | aagccagaac | aactggctac | ggaccaagtt tatccggcag | 240 |
| cgtggcgccc | accgcatcca | cgtggagatg | aagttttcgg | tgcgtgactg cagcagcatc | 300 |
| cccagcgtgc | ctggctcctg | caaggagacc | ttcaacctct | attactatga ggctgacttt | 360 |
| gactcggcca | ccaagacctt | ccccaactgg | atggagaatc | catgggtgaa ggtggatacc | 420 |
| attgcagccg | acgagagctt | ctcccaggtg | gacctgggtg | gccgcgtcat gaaaatcaat | 480 |
| accgaggtgc | ggagcttcgg | acctgtgtcc | cgcagcggct | tctacctggc cttccaggac | 540 |
| tatggcggct | gcatgtccct | catcgccgtg | cgtgtcttct | accgcaagtg ccccgcatc | 600 |
| atccagaatg | gcgccatctt | ccaggaaacc | ctgtcggggg | ctgagagcac atcgctggtg | 660 |
| gctgcccggg | gcagctgcat | cgccaatgcg | gaagaggtgg | atgtacccat caagctctac | 720 |
| tgtaacgggg | acggcgagtg | gctggtgccc | atcgggcgct | gcatgtgcaa agcaggcttc | 780 |
| gaggccgttg | agaatggcac | cgtctgccga | ggttgtccat | ctgggacttt caaggccaac | 840 |
| caaggggatg | aggcctgtac | ccactgtccc | atcaacagcc | ggaccacttc tgaaggggcc | 900 |
| accaactgtg | tctgccgcaa | tggctactac | agagcagacc | tggaccccct ggacatgccc | 960 |
| tgcacaacca | tcccctccgc | gccccaggct | gtgatttcca | gtgtcaatga gacctccctc | 1020 |
| atgctggagt | ggaccccctcc | ccgcgactcc | ggaggccgag | aggacctcgt ctacaacatc | 1080 |
| atctgcaaga | gctgtggctc | gggccggggt | gcctgcaccc | gctgcgggga caatgtacag | 1140 |
| tacgcaccac | gccagctagg | cctgaccgag | ccacgcattt | acatcagtga cctgctggcc | 1200 |
| cacacccagt | acaccttcga | gatccaggct | gtgaacggcg | ttactgacca gagcccttc | 1260 |
| tcgcctcagt | tcgcctctgt | gaacatcacc | accaaccagg | cagctccatc ggcagtgtcc | 1320 |
| atcatgcatc | aggtgagccg | caccgtggac | agcattaccc | tgtcgtggtc ccagccggac | 1380 |
| cagcccaatg | gcgtgatcct | ggactatgag | ctgcagtact | atgagaagga gctcagtgag | 1440 |
| tacaacgcca | cagccataaa | aagccccacc | aacacggtca | ccgtgcaggg cctcaaagcc | 1500 |
| ggcgccatct | atgtcttcca | ggtgcgggca | cgcaccgtgg | caggctacgg gcgctacagc | 1560 |
| ggcaagatgt | acttccagac | catgacagaa | gccgagtacc | agacaagcat ccaggagaag | 1620 |
| ttgccactca | tcatcggctc | ctcggccgct | ggcctggtct | tcctcattgc tgtggttgtc | 1680 |
| atcgccatcg | tgtgtaacag | aagacggggg | tttgagcgtg | ctgactcgga gtacacggat | 1740 |
| aagctgcaac | actacaccag | tggccacatg | accccaggca | tgaagatcta catcgatcct | 1800 |
| ttcacctacg | aggaccccaa | cgaggcagtg | cgggagtttg | ccaaggaaat tgacatctcc | 1860 |
| tgtgtcaaaa | ttgagcaggt | gatcggagca | ggggagtttg | gcgaggtctg cagtggccac | 1920 |
| ctgaagctgc | caggcaagag | agagatcttt | gtggccatca | agacgctcaa gtcgggctac | 1980 |
| acggagaagc | agcgccggga | cttcctgagc | gaagcctcca | tcatgggcca gttcgaccat | 2040 |
| cccaacgtca | tccacctgga | gggtgtcgtg | accaagagca | cacctgtgat gatcatcacc | 2100 |
| gagttcatgg | agaatggctc | cctggactcc | tttctccggc | aaaacgatgg gcagttcaca | 2160 |
| gtcatccagc | tggtgggcat | gcttcggggc | atcgcagctg | gcatgaagta cctggcagac | 2220 |
| atgaactatg | ttcaccgtga | cctggctgcc | cgcaacatcc | tcgtcaacag caacctggtc | 2280 |

TABLE 2-continued

```
tgcaaggtgt cggactttgg gctctcacgc tttctagagg acgatacctc agacccacc    2340
tacaccagtg ccctgggcgg aaagatcccc atccgctgga cagccccgga agccatccag   2400
taccggaagt tcacctcggc cagtgatgtg tggagctacg gcattgtcat gtgggaggtg   2460
atgtcctatg gggagcggcc ctactgggac atgaccaacc aggatgtaat caatgccatt   2520
gagcaggact atcggctgcc accgcccatg gactgcccga gcgccctgca ccaactcatg   2580
ctggactgtt ggcagaagga ccgcaaccac cggcccaagt tcggccaaat tgtcaacacg   2640
ctagacaaga tgatccgcaa tcccaacagc ctcaaagcca tggcgcccct ctcctctggc   2700
atcaacctgc cgctgctgga ccgcacgatc cccgactaca ccagctttaa cacggtggac   2760
gagtgcctgg aggccatcaa gatggggcag tacaaggaga gcttcgccaa tgccggcttc   2820
acctcctttg acgtcgtgtc tcagatgatg atggaggaca ttctccgggt tggggtcact   2880
ttggctggcc accagaaaaa aatcctgaac agtatccagg tgatgcgggc gcagatgaac   2940
cagattcagt ctgtggaggt ttga                                          2964
```

SEQ ID NO: 137 Human ephrin type-B receptor 2 (EPHB2) cDNA sequence, transcript variant 3 (NM_001309192.1)

```
atggctctgc ggaggctggg ggccgcgctg ctgctgctgc cgctgctcgc cgccgtggaa   60
gaaacgctaa tggactccac tacagcgact gctgagctgg gctggatggt gcatcctcca   120
tcagggtggg aagaggtgag tggctacgat gagaacatga acacgatccg cacgtaccag   180
gtgtgcaacg tgtttgagtc aagccagaac aactggctac ggaccaagtt tatccggcgc   240
cgtggcgccc accgcatcca cgtggagatg aagttttcgg tgcgtgactg cagcagcatc   300
cccagcgtgc ctggctcctg caaggagacc ttcaacctct attactatga ggctgacttt   360
gactcggcca ccaagacctt ccccaactgg atggagaatc atgggtgaa ggtggatacc    420
attgcagccg acgagagctt ctcccaggtg gacctgggtg gccgcgtcat gaaaatcaac   480
accgaggtgc ggagcttcgg acctgtgtcc cgcagcggct tctacctggc cttccaggac   540
tatgcggct gcatgtccct catcgccgtg cgtgtcttct accgcaagtg ccccgcatc     600
atccagaatg cgccatctt ccaggaaacc ctgtcggggg ctgagagcac atcgctggtg    660
gctgcccggg gcagctgcat cgccaatgcg aagaggtgg atgtacccat caagctctac    720
tgtaacgggg acggcgagtg gctggtgccc atcgggcgct gcatgtgcaa agcaggcttc   780
gaggccgttg agaatggcac cgtctgccga ggttgtccat ctgggacttt caaggccaac   840
caaggggatg aggcctgtac ccactgtccc atcaacagcc ggaccacttc tgaaggggcc   900
accaactgtg tctgccgcaa tggctactac agagcagacc tggacccct ggacatgccc    960
tgcacaacca tccccctccgc gccccaggct gtgatttcca gtgtcaatga cctccctc   1020
atgctggagt ggaccctcc ccgcgactcc ggaggccgag aggacctcgt ctacaacatc   1080
atctgcaaga gctgtggctc gggcggggt gcctgcaccc gctgcggga caatgtacag    1140
tacgcaccac gccagctagg cctgaccgag ccacgcattt acatcagtga cctgctggcc   1200
cacacccagt acaccttcga gatccaggct gtgaacggcg ttactgacca gagcccttc   1260
tcgcctcagt tcgcctctgt gaacatcacc accaaccagg cagctccatc ggcagtgtcc   1320
atcatgcatc aggtgagccg caccgtggac agcattaccc tgtcgtggtc ccagccggac   1380
cagcccaatg gcgtgatcct ggactatgag ctgcagtact atgagaagga gctcagtgag   1440
tacaacgcca cagccataaa aagccccacc aacacggtca ccgtgcaggg cctcaaagcc   1500
ggcgccatct atgtcttcca ggtgcgggca cgcaccgttg cagagctcgg gcgctacagc   1560
ggcaagatgt acttccagac catgacagaa gtgaccccag gcatgaagat ctacatcgat   1620
cctttcacct acgaggaccc caacgaggca gtgcgggagt tgccaagga aattgacatc   1680
tcctgtgtca aaattgagca ggtgatcgga gcaggggagt ttggcgaggt ctgcagtggc   1740
cacctgaagc tgccaggcaa gagagagatc tttgtggcca tcaagactct caagtcggag   1800
tacacggaga agcagcgccg ggacttcctg agcgaagcct ccatcatggg ccagttcgac   1860
catcccaacg tcatccacct ggagggtgtc gtgaccaaga gcacacctgt gatgatcatc   1920
accgagttca tggagaatgg ctccctggac tcctttctcc ggcaaaacga tgggcagttc   1980
acagtcatcc agctggtgg catgcttcgg ggcatcgcag ctggcatgaa gtacctggca   2040
gacatgaact atgttcaccg tgacctggct gcccgcaaca tcctcgtcaa cagcaacctg   2100
gtctgcaagg tgtcggactt tgggctctca cgctttctag aggacgatac ctcagaccc    2160
acctacacca gtgccctggg cggaaagatc cccatccgct ggacagcccc ggaagccatc   2220
cagtaccgga agttcacctc ggccagtgat gtgtggagct acggcattgt catgtgggag   2280
gtgatgtcct atggggagcg gccctactgg gacatgacca accaggatgt aatcaatgcc   2340
attgagcagg actatcggct gccaccgccc atggactgcc cgagcgccct gcaccaactc   2400
atgctggact gttggcagaa ggaccgcaac caccggccca agtcggcca aattgtcaac     2460
acgctagaca agatgatccg caatcccaac agcctcaaag ccatggcgcc cctcctct    2520
ggcatcaacc tgccgctgct ggaccgcacg atccccgact acaccagctt taacacggt    2580
gacgagtggc tggaggccat caagatgggg cagtacaagg agagcttcgc caatgccggc   2640
ttcacctcct ttgacgtcgt gtctcagatg atgatggagg acattctccg ggttggggtc   2700
actttggctg gccaccagaa aaaaatcctg aacagtatcc aggtgatgcg ggcgcagatg   2760
aaccagattc agtctgtgga ggtttga                                       2787
```

SEQ ID NO: 138 Human ephrin type-B receptor 2 (EPHB2) cDNA sequence, transcript variant 4 (NM_001309193.1)

```
atggctctgc ggaggctggg ggccgcgctg ctgctgctgc cgctgctcgc cgccgtggaa   60
gaaacgctaa tggactccac tacagcgact gctgagctgg gctggatggt gcatcctcca   120
tcagggtggg aagaggtgag tggctacgat gagaacatga acacgatccg cacgtaccag   180
gtgtgcaacg tgtttgagtc aagccagaac aactggctac ggaccaagtt tatccggcgc   240
cgtggcgccc accgcatcca cgtggagatg aagttttcgg tgcgtgactg cagcagcatc   300
cccagcgtgc ctggctcctg caaggagacc ttcaacctct attactatga ggctgacttt   360
gactcggcca ccaagacctt ccccaactgg atggagaatc atgggtgaa ggtggatacc    420
attgcagccg acgagagctt ctcccaggtg gacctgggtg gccgcgtcat gaaaatcaac   480
accgaggtgc ggagcttcgg acctgtgtcc cgcagcggct tctacctggc cttccaggac   540
tatgcggct gcatgtccct catcgccgtg cgtgtcttct accgcaagtg ccccgcatc     600
atccagaatg cgccatctt ccaggaaacc ctgtcggggg ctgagagcac atcgctggtg    660
gctgcccggg gcagctgcat cgccaatgcg aagaggtgg atgtacccat caagctctac    720
tgtaacgggg acggcgagtg gctggtgccc atcgggcgct gcatgtgcaa agcaggcttc   780
```

TABLE 2-continued

```
gaggccgttg agaatggcac cgtctgccga ggttgtccat ctgggacttt caaggccaac    840
caaggggatg aggcctgtac ccactgtccc atcaacagcc ggaccacttc tgaaggggcc    900
accaactgtg tctgccgcaa tggctactac agagcagacc tggacccct ggacatgccc    960
tgccacaacca tcccctccgc gccccaggct gtgatttcca gtgtcaatga gacctccctc    1020
atgctggagt ggacccctcc ccgcgactcc ggaggccgag aggacctcgt ctacaacatc    1080
atctgcaaga gctgtggctc ggggccgggtt gcctgcaccc gctgcgggga caatgtacag    1140
tacgcaccac gccagctagg cctgaccgag ccacgcattt acatcagtga cctgctggcc    1200
cacacccagt acaccttcga gatccaggct gtgaacggcg ttactgacca gagccccttc    1260
tcgcctcagt tcgcctctgt gaacatcacc accaaccagg cagctccatc ggcagtgtcc    1320
atcatgcatc aggtgagccg caccgtggac agcattaccc tgtcgtggtc ccagccggac    1380
cagcccaatg gcgtgatcct ggactatgag ctgcagtact atgagaagga gctcagtgag    1440
tacaacgcca cagccataaa aagccccacc aacacggtca ccgtgcaggg cctcaaagcc    1500
ggcgccatct atgtcttcca ggtgcgggca cgcaccgtgg caggctacgg gcgctacagc    1560
ggcaagatgt acttccagac catgacagaa gccgagtacc agacaagcat ccaggagaag    1620
ttgccactca tcatcggctc ctcggccgct ggcctggtct tcctcattgc tgtggttgtc    1680
atcgccatcg tgtgtaacag acgggggttt gagcgtgctg actcggagta cacggacaag    1740
ctgcaacact acaccagtgg ccacatgacc ccaggcatga agatctacat cgatcctttc    1800
acctacgagg acccccaacga ggcagtgcgg gagtttgcca aggaaattga catctcctgt    1860
gtcaaaattg agcaggtgat cggagcaggg gagtttggcg aggtctgcag tggccacctg    1920
aagctgccag gcaagagaga gatctttgtg gccatcaaga cgctcaagtc gggctacacg    1980
gagaagcagc gccgggactt cctgagcgaa gcctccatca tgggccagtt cgaccatccc    2040
aacgtcatcc acctggaggg tgtcgtgacc aagagcacac ctgtgatgat catcaccgag    2100
ttcatggaga atggccccct ggactccttt ctccggcaaa acgatgggca gttcacagtc    2160
atccagctgg tgggcatgct tcggggcatc gcagctggca tgaagtacct ggcagacatg    2220
aactatgttc accgtgacct ggctgcccgc aacatcctcg tcaacagcaa cctggtctgc    2280
aaggtgtcgg actttgggct ctcacgcttt ctagaggacg ataccctcaga ccccacctac    2340
accagtgccc tgggcggaaa gatccccatc cgctggacag ccccggaagc catccagtac    2400
cggaagttca cctcggccag tgatgtgtgg agctacggca ttgtcatgtg ggaggtgatg    2460
tcctatgggg agcggcccta ctgggacatg accaaccaga atgtaatcaa tgccattgag    2520
caggactatc ggctgcccc gcccatggac tgcccgagcg ccctgcacca actcatgctg    2580
gactgttggc agaaggaccg caaccaccgg cccaagtcg gccaaattgt caacacgcta    2640
gacaagatga tccgcaatcc caacagcctc aaagccatgg cgccctc ctctggcatc    2700
aacctgccgc tgctggaccg cacgatcccc gactacacca gctttaacac ggtggacgag    2760
tggctggagg ccatcaagat ggggcagtac aaggagagct tcgccaatgc cggcttcacc    2820
tcctttgacg tcgtgtctca gatgatgatg gaggacattc tccgggttgg ggtcactttg    2880
gctgccacc agaaaaaaat cctgaacagt atccaggtga tgcgggcgca gatgaaccag    2940
attcagtctg tggaggca gccactcgcc aggaggccac gggccacggg aagaaccaag    3000
cggtgccagc cacgagacgt caccaagaaa acatgcaact caaacgacgg aaaaaaaaag    3060
ggaatgggaa aaaagaaaac agatcctggg aggggcggg aaatacaagg aatattttt    3120
aaagaggatt ctcataagga aagcaatgac tgttcttgcg ggggataa              3168
```

SEQ ID NO: 139 Human ephrin type-B receptor 2 (EPHB2) amino acid sequence, isoform 1 (NP_059145.2)

```
MALRRLGAAL LLLPLLAAVE ETLMDSTTAT AELGWMVHPP SGWEEVSGYD ENMNTIRTYQ     60
VCNVFESSQN NWLRTKFIRR RGAHRIHVEM KFSVRDCSSI PSVPGSCKET FNLYYYEADF    120
DSAIKTFPNW MENPWVKVDT IAADESFSQV DLGGRVMKIN TEVRSEGPVS RSGFYLAFQD    180
YGGCMSLIAV RVFYRKCPRI IQNGAIFQET LSGAESTSLV AARGSCIANA EEVDVPIKLY    240
CNGDGEWLVP IGRCMCKAGF EAVENGTVCR GCPSGTFKAN QGDEACTHCP INSRTTSEGA    300
TNCVCRNGYY RADLDPLDMP CTTIPSAPQA VISSVNETSL MLEWTPPRDS GGREDLVYNI    360
ICKSCGSGRG ACTRCGDNVQ YAPRQLGLTE PRIYISDLLA HTQYTTEIQA VNGVIDQSPF    420
SPQFASVNIT TNQAAPSAVS IMHQVSRTVD SITLSWSQPD QPNGVILDYE LQYYEKELSE    480
YNATAIKSPT NTVTVQGLKA GAIYVFQVRA RTVAGYGRYS GKMYFQTMTE AEYQTSIQEK    540
LPLIIGSSAA GLVFLIAVVV IAIVCNRRGF ERADSEYTDK LQHYTSGHMT PGMKIYIDPF    600
TYEDPNEAVR EFAKEIDISC VKIEQVIGAG EFGEVCSGHL KLPGKREIFV AIKTLKSGYT    660
EKQRRDFLSE ASIMGQFDHP NVIHLEGVVI KSTPVMIITE FMENGSLDSF LRQNDGQFTV    720
IQLVGMLRGI AAGMKYLADM NYVHRDLAAR NILVNSNLVC KVSDFGLSRF LEDDTSDPTY    780
TSALGGKIPI RWTAPEAIQY RKFTSASDVW SYGIVMWEVM SYGERPYWDM TNQDVINAIE    840
QDYRLPPPMD CPSALHQLML DCWQKDRNHR PKFGQIVNTL DKMIRNPNSL KAMAPLSSGI    900
NLPLLDRTIP DYTSFNTVDE WLEAIKMGQY KESFANAGFT SFDVVSQMMM EDILRVGVTL    960
AGHQKKILNS IQVMRAQMNQ IQSVEV                                         986
```

SEQ ID NO: 140 Human ephrin type-B receptor 2 (EPHB2) amino acid sequence, isoform 2 (NP_004433.2)

```
MALRRLGAAL LLLPLLAAVE ETLMDSTTAT AELGWMVHPP SGWEEVSGYD ENMNTIRTYQ     60
VCNVFESSQN NWLRTKFIRR RGAHRIHVEM KFSVRDCSSI PSVPGSCKET FNLYYYEADF    120
DSATKTFPNW MENPWVKVDT IAADESFSQV DLGGRVMKIN TEVRSFGPVS RSGFYLAFQD    180
YGGCMSLIAV RVFYRKCPRI IQNGAIFQET LSGAESTSLV AARGSCIANA EEVDVPIKLY    240
CNGDGEWLVP IGRCMCKAGF EAVENGTVCR GCPSGTFKAN QGDEACTHCP INSRTTSEGA    300
TNCVCRNGYY RADLDPLDMP CTTIPSAPQA VISSVNETSL MLEWTPPRDS GGREDLVYNI    360
ICKSCGSGRG ACTRCGDNVQ YAPRQLGLTE PRIYISDLLA HTQYTFEIQA VNGVTDQSPF    420
SPQFASVNIT TNQAAPSAVS IMHQVSRTVD SITLSWSQPD QPNGVILDYE LQYYEKELSE    480
YNATAIKSPT NTVTVQGLKA GAIYVFQVRA RTVAGYGRYS GKMYFQTMTE AEYQTSIQEK    540
LPLIIGSSAA GLVFLIAVVV IAIVCNRRRG FERADSEYTD KLQHYTSGHM TPGMKIYIDP    600
FTYEDPNEAV REFAKEIDIS CVKIEQVIGA GEFGEVCSGH LKLPGKREIF VAIKTLKSGY    660
TEKQRRDFLS EASIMGQFDH PNVIHLEGVV TKSTPVMIIT EFMENGSLDS FLRQNDGQFT    720
VIQLVGMLRG IAAGMKYLAD MNYVHRDLAA RNILVNSNLV CKVSDFGLSR FLEDDTSDPT    780
YTSALGGKIP IRWTAPEAIQ YRKFTSASDV WSYGIVMWEV MSYGERPYWD MTNQDVINAI    840
EQDYRLPPPM DCPSALHQLM LDCWQKDRNH RPKFGQIVNT LDKMIRNPNS LKAMAPLSSG    900
```

TABLE 2-continued

```
INLPLLDRTI PDYTSFNTVD EWLEAIKMGQ YKESFANAGF TSFDVVSQMM MEDILRVGVT    960
LAGHQKKILN SIQVMRAQMN QIQSVEV                                       987
```

SEQ ID NO: 141 Human ephrin type-B receptor 2 (EPHB2) amino acid
sequence, isoform 3 (NP_001296121.1)

```
MALRRLGAAL LLLPLLAAVE ETLMDSTTAT AELGWMVHPP SGWEEVSGYD ENMNTIRTYQ     60
VCNVFESSQN NWLRTKFIRR RGAHRIHVEM KFSVRDCSSI PSVPGSCKET FNLYYYEADF    120
DSATKTFPNW MENPWVKVDT IAADESFSQV DLGGRVMKIN TEVRSEGPVS RSGFYLAFQD    180
YGGCMSLIAV RVFYRKCPRI IQNGAIFQET LSGAESTSLV AARGSCIANA EEVDVPIKLY    240
CNGDGEWLVP IGRCMCKAGF EAVENGTVCR GCPSGTFKAN QGDEACTHCP INSRTTSEGA    300
TNCVCRNGYY RADLDPLDMP CTTIPSAPQA VISSVNETSL MLEWTPPRDS GGREDLVYNI    360
ICKSCGSGRG ACTRCGDNVQ YAPRQLGLTE PRIYISDLLA HTQYTFEIQA VNGVTDQSPF    420
SPQFASVNIT TNQAAPSAVS IMHQVSRTVD SITLSWSQPD QPNGVILDYE LQYYEKELSE    480
YNATAIKSPT NTVTVQGLKA GAIYVFQVRA RTVAGYGRYS GKMYFQTMTE VTPGMKIYID    540
PFTYEDPNEA VREFAKEIDI SCVKIEQVIG AGEFGEVCSG HLKLPGKREI FVAIKTLKSG    600
YTEKQRRDFL SEASIMGQFD HPNVIHLEGV VTKSTPVMII TEFMENGSLD SFLRQNDGQF    660
TVIQLVGMLR GIAAGMKYLA DMNYVHRDLA ARNILVNSNL VCKVSDFGLS RFLEDDTSDP    720
TYTSALGGKI PIRWTAPEAI QYRKFTSASD VWSYGIVMWE VMSYGERPYW DMTNQDVINA    780
IEQDYRLPPP MDCPSALHQL MLDCWQKDRN HRPKFGQIVN TLDKMIRNPN SLKAMAPLSS    840
GINLPLLDRT IPDYTSFNTV DEWLEAIKMG QYKESFANAG FTSFDVVSQM MMEDILRVGV    900
TLAGHQKKIL NSIQVMRAQM NQIQSVEV                                      928
```

SEQ ID NO: 142 Human ephrin type-B receptor 2 (EPHB2) amino acid
sequence, isoform 4 (NP_001296122.1)

```
MALRRLGAAL LLLPLLAAVE ETLMDSTTAT AELGWMVHPP SGWEEVSGYD ENMNTIRTYQ     60
VCNVFESSQN NWLRTKFIRR RGAHRIHVEM KFSVRDCSSI PSVPGSCKET FNLYYYEADF    120
DSATKTFPNW MENPWVKVDT IAADESFSQV DLGGRVMKIN TEVRSEGPVS RSGFYLAFQD    180
YGGCMSLIAV RVFYRKCPRI IQNGAIFQET LSGAESTSLV AARGSCIANA EEVDVPIKLY    240
CNGDGEWLVP IGRCMCKAGF EAVENGTVCR GCPSGTFKAN QGDEACTHCP INSRTTSEGA    300
TNCVCRNGYY RADLDPLDMP CTTIPSAPQA VISSVNETSL MLEWTPPRDS GGREDLVYNI    360
ICKSCGSGRG ACTRCGDNVQ YAPRQLGLTE PRIYISDLLA HTQYTFEIQA VNGVTDQSPF    420
SPQFASVNIT TNQAAPSAVS IMHQVSRTVD SITLSWSQPD QPNGVILDYE LQYYEKELSE    480
YNATAIKSPT NTVTVQGLKA GAIYVFQVRA RTVAGYGRYS GKMYFQTMTE AEYQTSIQEK    540
LPLIIGSSAA GLVFLIAVVV IAIVCNRRGF ERADSEYTDK LQHYTSGHMT PGMKIYIDPF    600
TYEDPNEAVR EFAKEIDISC VKIEQVIGAG EFGEVCSGHL KLPGKREIFV AIKTLKSGYT    660
EKQRRDFLSE ASIMGQFDHP NVIHLEGVVT KSTPVMIITE FMENGSLDSF LRQNDGQFTV    720
IQLVGMLRGI AAGMKYLADM NYVHRDLAAR NILVNSNLVC KVSDFGLSRF LEDDTSDPTY    780
TSALGGKIPI RWTAPEAIQY RKFTSASDVW SYGIVMWEVM SYGERPYWDM TNQDVINAIE    840
QDYRLPPPMD CPSALHQLML DCWQKDRNHR PKFGQIVNTL DKMIRNPNSL KAMAPLSSGI    900
NLPLLDRTIP DYTSENTVDE WLEAIKMGQY KESFANAGFT SFDVVSQMMM EDILRVGVTL    960
AGHQKKILNS IQVMRAQMNQ IQSVEGQPLA RRPRATGRIT RCQPRDVTKK TCNSNDGKKK   1020
GMGKKKTDPG RGREIQGIFF KEDSHKESND CSCGG                              1055
```

SEQ ID NO: 143 Mouse ephrin type-B receptor 2 (EPHB2) cDNA sequence,
transcript variant 1 (NM_001290753.2)

```
atggccgtgc gcaggctggg ggccgcgctg ctgctgctgc cgctgctagc cgccgtggaa     60
gaaaccctga tggactctac gacagcaacg gctgagctgg gctggatggt acatcccca    120
tcagggtggg aagaggtgag cggctacgac gagaacatga acactatccg tacctaccag    180
gtgtgcaatg tctttgagtc aagccagaac aactggctgc ggaccaaatt catccggcgc    240
cgcggcgccc accgcatcca cgtggagatg aagttctcgg tgcgtgactg cagcagcatt    300
cccagcgtgc cgggctcctg caaggagacc ttcaacctct actactatga ggctgattt    360
gacttagcca ccaaaacctt tcccaactgg atggagaatc cgtgggtgaa ggtggacacc    420
atcgcggccg atgagagctt ctctcaggtg gacctgggtg gccgcgtcat gaaaatcaac    480
actgaggtgc gaagcttcgg tcccgtgtcc cgcaatggtt tctacctggc cttccaggac    540
tatggcgggt gtatgtccct cattgctgtg cgcgtcttct accggaagtg ccccgaatc    600
atccagaatg gtgccatctt ccaggagaca ctgtcggagg ctgagagcac ttcgctggtg    660
gcagctcggg gcagctgcat cgccaatgct gaagaagtgg atgtgcccat caaactctac    720
tgtaacgggg acggcgaatg gctggtgccc ataggtcgct gcatgtgcaa ggcgggcttc    780
gaggctgtgg agaacggcac cgtctgccga ggttgtccat caggaacctt caaggccaac    840
caaggggacg aagcctgcac ccactgtccc atcaacagcc gcaccctc cgagggtgcc    900
accaactgtg tatgccgcaa cggctactac agggccgacc tggaccctt agacatgcct    960
tgcacaacca tccctctgc gcccaggct gtgatctcca cgtcaacga cgtccctc      1020
atgctagagt ggaccccacc ccgagactcg ggggtcgcg aggatcttgt ttacaacatc   1080
atctgcaaga gctgtggctc cggccggggc gcatgcacgc gtgcgggga caacgtgcag   1140
tacgcgcccc gccagctggg cctgactgag ccgcgcatct acatcagtga cctgctggca   1200
cacacgcagt acaccttcga gatccaggcc gtgaacggtg tgactgacca gagtcccttc   1260
tcacctcagt tcgcctctgt gaacatcacc accaaccaag cagcaccatc ggccgtgtcc   1320
atcatgcacc aggtgagccg cactgtggac agcatcacc tgtcgtggtc ccagccaga   1380
cagcccaacg gtgtgatcct ggactacgag ctgcagtact atgagaagca ggagctcagt   1440
gagtacaacg ccacgccat aaaagccc accaacacg tcactgtgca gggcctcaaa    1500
gccggcgcca tctatgtctt ccaggtgcgg gcacgcaccg ttgcaggcta tgggcgctac   1560
agtggcaaga tgtacttcca aaccatgaca gaagccgagt accagaccag catcaaggaa   1620
aagctaccc tcatcgttgg ctcctccgcc gccggcttag tcttcctcat cgctgtggtc   1680
gtcattgcca tcgtatgtaa cagacggggg tttgagcgtg ccgactcaga gtacacggac   1740
aagctacaac actacaccag cggacacatg ccccaggca tgaagatcta tatagaccct   1800
ttcacctatg aagatcctaa tgaggcagtg cgggagtttg ccaaggaaat tgacatctcc   1860
tgtgtcaaga ttgagcaggt gatcggagca ggggaatttg gtgaggtctg cagtggccat   1920
```

TABLE 2-continued

```
ttgaagctgc caggcaagag agagatcttt gtagccatca agaccctcaa gtcaggatac    1980
acggagaaac agcgccggga cttcctgagt gaggcatcca tcatgggcca gttcgaccac    2040
cccaatgtca tccatctgga aggggttgtc accaagagca cacctgtcat gatcatcact    2100
gaattcatgg agaacggatc tctggactcc ttcctccggc aaaacgatgg gcagttcaca    2160
gtcatccaac tggtgggcat gctgaggggc attgcagccg gcatgaagta cctggcggac    2220
atgaactacg tgcaccgtga ccttgctgct cgaaacatcc tcgtcaacag caacctggtg    2280
tgtaaggtgt ctgattttgg gctctcacgc ttcctggagg atgacacgtc tgaccccacc    2340
tataccagcg ctctgggtgg gaagatcccc atccgttgga cggcaccgga agccatccag    2400
taccggaaat tcacctcggc cagtgatgtg tggagctatg gcatcgtcat gtgggaggtg    2460
atgtcctacg gggaacgacc ctactggac atgaccaatc aagacgtaat caacgccatt    2520
gaacaggact acagactacc tccgcccatg gactgcccta gtgccctgca ccagctcatg    2580
ctggactgct ggcagaagga ccgcaaccac cggcccaagt cggccagat tgtcaacacg    2640
ctggacaaga tgatccgaaa ccccaacagc ctcaaagcca tggcacccct gtcctctgtg    2700
atcaacctgc cactgctgga ccgcacgata ccggactaca ccagctttaa cacggtggat    2760
gagtggctag aggccatcaa gatgggccag tacaaggaga gctttgccaa cgccggcttt    2820
acctcttcg acgttgtatc tcagatgatg atggaggaca ttctccgcgt tggggtcact    2880
ctagctggcc accagaaaaa aatcctgaac agtatccagg tgatgcgggc ccagatgaac    2940
cagatccagt ctgtagaggt ttga                                          2964
```

SEQ ID NO: 144 Mouse ephrin type-B receptor 2 (EPHB2) cDNA sequence, transcript variant 2 (NM_010142.4)

```
atggccgtgc gcaggctggg ggccgcgctg ctgctgctgc cgctgctagc cgccgtggaa     60
gaaaccctga tggactctac gacagcaacg gctgagctgg gctggatggt acatccccca    120
tcagggtggg aagaggtgag cggctacgac gagaacatga acactatccg tacctaccag    180
gtgtgcaatg tctttgagtc aagccagaac aactggctgc ggaccaaatt catccggcgc    240
cgcggcgccc accgcatcca cgtggagatg aagttctcgg tgcgtgactg cagcagcatt    300
cccagcgtgc cgggctcctg caaggagacc ttcaacctct actactatga ggctgatttt    360
gacttagcca ccaaaaactt tcccaactgg atggagaatc cgtgggtgaa ggtgacaac    420
atcgcggccg atgagagctt ctctcaggtg gacctgggtg gccgcgtcat gaaaatcaac    480
actgaggtgc gaagcttcgg tccgtgtcc gcaatggtt tctacctggc cttccaggac    540
tatgcggct gtatgtccct cattgctgtg cgcgtcttct accggaagtg ccccgaatc    600
atccagaatg gtgccatctt ccaggagaca ctgtcgggg ctgagagcac ttcgctggtg    660
gcagctggg gcagctgcat cgccaatgct gaagaagtga atgtgcccat caaactctac    720
tgtaacgggg acggcgaatg gctggtgccc ataggtcgct gcatgtgcaa ggcgggcttc    780
gaggctgtgg agaacggcac cgtctgccga ggttgtccat caggaaccttc aaggccaac    840
caaggggacg aagcctgcac ccactgtccc atcaacagcc gcaccactc cgagggtgcc    900
accaactgtg tatgccgcaa cggctactac agggccgaac tggaccctt agacatgcct    960
tgcacaacca tccctctgc gccccaggct gtgatctcca gcgtcaacga gacgtccctc   1020
atgctagagt ggacccccac ccgagactcg ggggtcgcg aggatcttgt ttacaacatc   1080
atctgcaaga gctgtggctc cggccgggc gcatgcacgc gctgcgggga caacgtgcag   1140
tacgcgcccc gccagctggg cctgactgag ccgcgcatct acatcagtga tctgctggca   1200
cacacgcagt acaccttcga gatccaggcc gtgaacggtg tgactgacca gagtcccttc   1260
tcacctcagt tcgcctctgt gaacatcacc accaaccaag cagccatcc ggccgtgtcc   1320
atcatgcacc aggtgagccg cactgtggac agcatcaccc tgtcgtggtc ccagccagac   1380
cagcccaacg gtgtgatcct ggactacgag gtgcagtact atgagaaggga gctcagtgag   1440
tacaacgcca cggccataaa agcccccacc aacacagtca ctgtgcaggg cctcaaagcc   1500
ggcgccatct atgtcttcca ggtgcgggca cgcaccgttg caggctatgg gcgctacagt   1560
ggcaagatgt acttccaaac catgacagaa gccgagtacc agaccagcat caaggaaaag   1620
ctaccctca tcgttggctc ctccgccgcc ggcttagtct tcctcatcgc tgtggtcgtc   1680
attgccatcg tatgtaacag acgggggttt agcgtgccg actcagagta cacggacaag   1740
ctacaacact acaccagcgg acacatgacc ccaggcatga gatctatat agacccttc   1800
acctatgaag atcctaatga ggcagtgcgg gagtttgcca aggaaattga catctcctgt   1860
gtcaagattg agcaggtgat cggagcaggg gaatttggtg aggtctgcag tggccatttg   1920
aagctgccag gcaagagaga gatctttgta gccatcaagt ccctcaagtc aggatacacg   1980
gagaaacagc gccgggactt cctgagtgag gcatccatca tgggccagtt cgaccacccc   2040
aatgtcatcc atctggaagg ggttgtcacc aagagcacac tgtcatgat catcactgaa   2100
ttcatggaga cggatctct ggactccttc tccggcaaa acgatgggca gttcacagtc   2160
atccaactgg tgggcatgct gaggggcatt gcagccggca tgaagtacct ggcggacatg   2220
aactacgtgc accgtgacct tgctgctcga aacatcctcg tcaacagcaa cctggtgtgt   2280
aaggtgtctg attttgggct ctcacgcttc tggaggatg acacgtctga ccccacctat   2340
accagcgctc tgggtgggaa gatccccatc cgttggacgg caccggaagc catccagtac   2400
cggaaattca cctcggccag tgatgtgtgg agctatggca tcgtcatgtg gggaggtatg   2460
tcctacgggg aacgacccta ctgggacatg accaatcaag acgtaatcaa cgccattgaa   2520
caggactaca gactacctcc gcccatggac tgccctagtg ccctgcacca gctcatgctg   2580
gactgctggc agaaggaccg caaccaccgg cccaagttcg ccagattgt caacacgctg   2640
gacaagatga tccgaaaccc caacagcctc aaagccatgg cacccctgtc tctggcatc   2700
aacctgccac tgctgaccg cacgataccg gactacacca gctttaacac ggtggatgag   2760
tggctagagg ccatcaagat gggccagtac aaggagagct ttgccaacgc cggctttacc   2820
tctttcgacg ttgtatctca gatgatgatg gaggacattc tccgcgttgg ggtcactcta   2880
gctgccacc agaaaaaaat cctgaacagt atccaggtga tgcgggccca gatgaaccag   2940
atccagtctg tagaggtttg a                                             2961
```

SEQ ID NO: 145 Mouse ephrin type-B receptor 2 (EPHB2) amino acid sequence, isoform 1 (NP_001277682.1)

```
MAVRRLGAAL LLLPLLAAVE ETLMDSTTAT AELGWMVHPP SGWEEVSGYD ENMNTIRTYQ    60
VCNVFESSQN NWLRTKFIRR RGAHRIHVEM KFSVRDCSSI PSVPGSCKET FNLYYYEADF   120
DLATKIFPNW MENPWVKVDT IAADESFSQV DLGGRVMKIN TEVRSEGPVS RNGFYLAFQD   180
YGGCMSLIAV RVFYRKCPRI IQNGAIFQET LSGAESTSLV AARGSCIANA EEVDVPIKLY   240
```

TABLE 2-continued

```
CNGDGEWLVP IGRCMCKAGF EAVENGTVCR GCPSGTFKAN QGDEACTHCP INSRTTSEGA    300
TNCVCRNGYY RADLDPLDMP CTTIPSAPQA VISSVNETSL MLEWTPPRDS GGREDLVYNI    360
ICKSCGSGRG ACTRCGDNVQ YAPRQLGLTE PRIYISDLLA HIQYTFEIQA VNGVTDQSPF    420
SPQFASVNIT TNQAAPSAVS IMHQVSRTVD SITLSWSQPD QPNGVILDYE LQYYEKQELS    480
EYNATAIKSP TNTVTVQGLK AGAIYVFQVR ARTVAGYGRY SGKMYFQTMT EAEYQTSIKE    540
KLPLIVGSSA AGLVFLIAVV VIAIVCNRRG FERADSEYTD KLQHYTSGHM TPGMKIYIDP    600
FTYEDPNEAV REFAKEIDIS CVKIEQVIGA GEFGEVCSGH LKLPGKREIF VAIKTLKSGY    660
TEKQRRDELS EASIMGQFDH PNVIHLEGVV TKSTPVMIIT EFMENGSLDS FLRQNDGQFT    720
VIQLVGMLRG IAAGMKYLAD MNYVHRDLAA RNILVNSNLV CKVSDFGLSR FLEDDTSDPT    780
YTSALGGKIP IRWTAPEAIQ YRKFTSASDV WSYGIVMWEV MSYGERPYWD MTNQDVINAI    840
EQDYRLPPPM DCPSALHQLM LDCWQKDRNH RPKFGQIVNT LDKMIRNPNS LKAMAPLSSG    900
INLPLLDRTI PDYTSFNTVD EWLEAIKMGQ YKESFANAGF TSEDVVSQMM MEDILRVGVT    960
LAGHQKKILN SIQVMRAQMN QIQSVEV                                       987
```

SEQ ID NO: 146 Mouse ephrin type-B receptor 2 (EPHB2) amino acid
sequence, isoform 2 (NP_034272.1)

```
MAVRRLGAAL LLLPLLAAVE EILMDSTTAT AELGWMVHPP SGWEEVSGYD ENMNTIRTYQ     60
VCNVFESSQN NWLRTKFIRR RGAHRIHVEM KFSVRDCSSI PSVPGSCKET FNLYYYEADF    120
DLATKTFPNW MENPWVKVDT IAADESFSQV DLGGRVMKIN TEVRSEGPVS RNGFYLAFQD    180
YGGCMSLIAV RVFYRKCPRI IQNGAIFQET LSGAESTSLV AARGSCIANA EEVDVPIKLY    240
CNGDGEWLVP IGRCMCKAGF EAVENGTVCR GCPSGTFKAN QGDEACTHCP INSRTTSEGA    300
TNCVCRNGYY RADLDPLDMP CTTIPSAPQA VISSVNETSL MLEWTPPRDS GGREDLVYNI    360
ICKSCGSGRG ACTRCGDNVQ YAPRQLGLTE PRIYISDLLA HIQYTFEIQA VNGVTDQSPF    420
SPQFASVNIT TNQAAPSAVS IMHQVSRTVD SITLSWSQPD QPNGVILDYE LQYYEKELSE    480
YNATAIKSPT NTVTVQGLKA GAIYVFQVRA RTVAGYGRYS GKMYFQTMTE AEYQTSIKEK    540
LPLIVGSSAA GLVFLIAVVV IAIVCNRRGF ERADSEYTDK LQHYTSGHMT PGMKIYIDPF    600
TYEDPNEAVR EFAKEIDISC VKIEQVIGAG EFGEVCSGHL KLPGKREIFV AIKTLKSGYT    660
EKQRRDFLSE ASIMGQFDHP NVIHLEGVVT KSTPVMIITE FMENGSLDSF LRQNDGQFTV    720
IQLVGMLRGI AAGMKYLADM NYVHRDLAAR NILVNSNLVC KVSDFGLSRF LEDDTSDPTY    780
TSALGGKIPI RWTAPEAIQY RKFTSASDVW SYGIVMWEVM SYGERPYWDM TNQDVINAIE    840
QDYRLPPPMD CPSALHQLML DCWQKDRNHR PKFGQIVNTL DKMIRNPNSL KAMAPLSSGI    900
NLPLLDRTIP DYTSFNTVDE WLEAIKMGQY KESFANAGFT SFDVVSQMMM EDILRVGVTL    960
AGHQKKILNS IQVMRAQMNQ IQSVEV                                        986
```

SEQ ID NO: 147 Human gamma-aminobutyric acid type A receptor alpha4
subunit (GABRA4) cDNA, transcript variant 1 (NM_000809.3)

```
atggtttctg ccaagaaggt acccgcgatc gctctgtccg ccggggtcag tttcgccctc      60
ctgcgcttcc tgtgcctggc ggtttgttta aacgaatccc aggacagaa ccaaaaggag    120
gagaaattgt gcacagaaaa tttcacccgc atcctggaca gtttgctcga tggttatgac    180
aacaggctgc gtcctggatt tgggggtcct gttacagaa tgaaaactga catatatgtc    240
accagctttg gacctgtttc tgatgttgaa atggaataca caatggatgt gttcttcagg    300
cagacatgga ttgacaaaag attaaaatat gacggcccca ttgaaatttt gagattgaac    360
aatatgatga taacgaaagt gtggacccct gatacttttct tcaggaatgg aaagaaatct    420
gtctcacata atatgacagc tccaaataag ctttttagaa ttatgagaaa tggtactatt    480
ttatacacaa tgagactcac cataagtgcg gagtgtccca tgagattggt ggattttccc    540
atggatggtc atgcatgccc tttgaaattc gggagttatg cctatccaaa gagtgagatg    600
atctatacct ggacaaaagg tcctgagaaa tcagttgaag ttccgaagga gtcttccagc    660
ttagttcaat atgatttgat tgggcaaacc gtatcaagtg aaaccatcaa atcaattacg    720
ggtgaatata ttgttatgac ggtttacttc caccctcagac ggaagatggg ttatttttatg    780
attcagacct atattcgtgt cattatgaca gtgattcttt ctcaagtttc attttggata    840
aataaagaat cagttcccgc taggactgta tttggaataa caactgtcct caccatgacc    900
acactaagca tcagtgcacg acattctttg cccaaagtgt cctatgctac cgccatgagc    960
tggttcatag ctgtctgctt tgcttttgta ttttcggccc ttatcgagtt tgctcgtgtc   1020
aactatttca ccaatattca aatggaaaaa gccaaaagga gacatcaaa gccccctcag   1080
gaagttcccg ctgctccagt gcagagagag aagcatcctg aagcccctct gcagaataca   1140
aatgccaatt tgaacatgag aaaaagaaca aatgcttttgg ttcactctga atctgatgtt   1200
ggcaacagaa ctgaggtggg aaaccattca agcaaatcct ccacagttgt tcaagaatct   1260
tctaaaggca cacctcggtc ttacttagct tccagtccaa acccattcag ccgtgcaaat   1320
gcagctgaaa ccatatctgc agcaagagca cttccatctg ctttctccta ttctatccga   1380
actgatatat tgcctgaaa ggcttcagtt ggatctgctt ctactcgtca cgtgtttgga   1440
tcaagactgc agaggataaa gaccacagtt aataccatag ggctactggg gaagttgtca   1500
gctactcctc ctccatcggc tccaccacct tctggatctg gcacaagtaa aatagacaaa   1560
tatgcccgta ttctcttccc agtcacattt ggggcattta acatggtttta ttgggttgtt   1620
tatttatcta aggacactat ggagaaatca gaaagtctaa tgtaa                   1665
```

SEQ ID NO: 148 Human gamma-aminobutyric acid type A receptor alpha4
subunit (GABRA4) cDNA, transcript variant 2 (NM_001204266.1)

```
atgttgcaaa gatggttttct gccaagaagt ttaaacgaat ccccaggaca gaaccaaaag     60
gaggagaaat tgtgcacaga aaatttcacc cgcatcctgg acagtttgct cgatggttat    120
gacaacaggc tgcgtcctgg atttgggggt cctgttacag aagtgaaaac tgacatatat    180
gtcaccagct ttggacctgt ttctgatgtt gaaatggaat acacaatgga tgtgttcttc    240
aggcagacat ggattgacaa aagattaaaa tatgacggcc ccattgaaat tttgagattg    300
aacaatatga tggtaacgaa agtgtggacc cctgatactt tcttcaggaa tggaaagaaa    360
tctgtctcac ataatatgac agctccaaat aagctttttta gaattatgag aaatggtact    420
atttttatca caatgagact caccataagt gcggagtgtc ccatgagatt ggtggatttt    480
cccatggatg gtcatgcatg cccttttgaaa ttcgggagtt atgcctatcc aaagagtgag    540
atgatctata cctggacaaa aggtcctgag aaatcagttg aagttccgaa ggagtcttcc    600
```

TABLE 2-continued

```
agcttagttc aatatgattt gattgggcaa accgtatcaa gtgaaccat caaatcaatt    660
acgggtgaat atattgttat gacggtttac ttccacctca gacggaagat gggttatttt    720
atgattcaga cctatattcc gtgcattatg acagtgattc tttctcaagt ttcattttgg    780
ataaataaag aatcagttcc cgctaggact gtatttggaa taacaactgt cctcaccatg    840
accacactaa gcatcagtgc acgacattct tgcccaaag tgtcctatgc taccgccatg    900
gactggttca tagctgtctg ctttgctttt gtattttcgg cccttatcga gtttgctgct    960
gtcaactatt tcaccaatat tcaaatggaa aaagccaaaa ggaagacatc aaagcccct   1020
caggaagttc ccgctgctcc agtgcagaga gagaagcatc ctgaagcccc tctgcagaat  1080
acaaatgcca atttgaacat gagaaaaaga acaaatgctt tggttcactc tgaatctgat  1140
gttggcaaca gaactgaggt gggaaaccat tcaagcaaat cttccacagt tgttcaagaa  1200
tcttctaaag gcacacctcg gtcttactta gcttccagtc caaacccatt cagccgtgca  1260
aatgcagctg aaaccatatc tgcagcaaga gcacttccat ctgcttctcc tacttctatc  1320
cgaactggat atatgcctcg aaaggcttca gttggatctg cttctactcg tcacgtgttc  1380
ggatcaagac tgcagaggat aaagaccaca gttaatacca tagggggctac tgggaagttg  1440
tcagctactc ctcctccatc ggctccacca ccttctggat ctggcacaag taaaatagac  1500
aaatatgccc gtattctctt tccagtcaca tttgggggcat ttaacatggt ttattgggtt  1560
gtttatttat ctaaggacac tatggagaaa tcagaaagtc taatgtaa              1608
```

SEQ ID NO: 149 Human gamma-aminobutyric acid type A receptor alpha4
  subunit (GABRA4) cDNA, transcript variant 3 (NM_001204267.1)

```
atgttgcaaa gatggtttct gccaagaagt ttaaacgaat ccccaggaca gaaccaaaag    60
gaggagaaat tgtgcacaga aaatttcacc cgcatcctgg acagtttgct cgatggttat   120
gacaacaggc tgcgtcctgg atttgggggt cctgttacag aagtgaaaac tgacatatat   180
gtcaccagct ttggacctgt ttctgatgtt gaaatggaat acacaatgga tgtgttcttc   240
aggcagacat ggattgacaa aagattaaaa tatgacggcc ccattgaaat tttgagattg   300
aacaatatga tggtaacgaa agtgtggacc cctgatactt tcttcaggaa tggaaagaaa   360
tctgtctcac ataatatgac agctccaaat aagcttttta gaattatgag aaatggtact   420
atttataca caatgagact caccataagt gcggagtgtc ccatgagatt ggtggatttt   480
cccatggatg gtcatgcatg ccctttgaaa ttcgggagtt atgcctatcc aaagagtgag   540
atgatctata cctggacaaa aggtcctgag aaatcagttg aagttccgaa ggagtcttcc   600
agcttagttc aatatgattt gattgggcaa accgtatcaa gtgaaccat caaatcaatt   660
acgggaataa caactgtcct caccatgacc acactaagca tcagtgcacg acattctttg   720
cccaaagtgt cctatgctac cgccatggac tggtttcatag ctgtctgctt tgctttgta   780
ttttcggccc ttatcgagtt tgctgctgtc aactatttca ccaatattca aatggaaaaa   840
gccaaaagga gacatcaaa gccccctcag gaagttcccg ctgctccagt gcagagagag   900
aagcatcctg aagcccctct gcagaataca aatgccaatt tgaacatgag aaaaagaaca   960
aatgctttgg ttcactctga atctgatgtt ggcaacagaa ctgaggtggg aaaccattca  1020
agcaaatctt ccacagttgt tcaagaatct tctaaaggca cacctcggtc ttacttagct  1080
tccagtccaa acccattcag ccgtgcaaat gcagctgaaa ccatatcgc agcaagagca  1140
cttccatctg cttctcctac ttctatccga actggatata tgcctcgaaa ggcttcagtt  1200
ggatctgctt ctactcgtca cgtgtttgga caagactgca gaggtataaa gaccacagtt  1260
aataccatag ggctactgg gaagttgtca gctactcctc ctccatcggc tccaccacct  1320
tctggatctg gcacaagtaa aatagacaaa tatgcccgta ttctctttcc agtcacattt  1380
ggggcattta acatggttta ttgggttgtt tatttatcta aggacactat ggagaaatca  1440
gaaagtctaa tgtaa                                                   1455
```

SEQ ID NO: 150 Human gamma-aminobutyric acid type A receptor alpha4
  subunit (GABRA4) amino acid sequence, isoform 1 (NP_000800.2)

```
MVSAKKVPAI ALSAGVSFAL LRFLCLAVCL NESPGQNQKE EKLCTENFTR ILDSLLDGYD    60
NRLRPGFGGP VTEVKTDIYV TSFGPVSDVE MEYTMDVFFR QTWIDKRLKY DGPIEILRLN   120
NMMVTKVWTP DTFFRNGKKS VSHNMTAPNK LFRIMRNGTI LYTMRLTISA ECPMRLVDFP   180
MDGHACPLKF GSYAYPKSEM IYTWITGPEK SVEVPKESSS LVQYDLIGQT VSSETIKSIT   240
GEYIVMTVYF HLRRKMGYFM IQTYIPCIMT VILSQVSFWI NKESVPARTV FGITTVLTMT   300
TLSISARHSL PKVSYATAMD WFIAVCFAFV FSALIEFAAV NYFTNIQMEK AKRKTSKPPQ   360
EVPAAPVQRE KHPEAPLQNT NANLNMRKRT NALVHSESDV GNRTEVGNHS SKSSTVVQES   420
SKGTPRSYLA SSPNPFSRAN AAETISAARA LPSASPTSIR TGYMPRKASV GSASTRHVFG   480
SRLQRIKTTV NTIGATGKLS ATPPPSAPPP SGSGTSKIDK YARILFPVTF GAFNMVYWVV   540
YLSKDTMEKS ESLM                                                    554
```

SEQ ID NO: 151 Human gamma-aminobutyric acid type A receptor alpha4
  subunit (GABRA4) amino acid sequence, isoform 2 (NP_001191195.1)

```
MLQRWFLPRS LNESPGQNQK EEKLCTENFT RILDSLLDGY DNRLRPGFGG PVTEVKTDIY    60
VTSFGPVSDV EMEYTMDVFF RQTWIDKRLK YDGPIEILRL NNMMVTKVWT PDTFFRNGKK   120
SVSHNMTAPN KLFRIMRNGT ILYTMRLTIS AECPMRLVDF PMDGHACPLK FGSYAYPKSE   180
MIYTWTKGPE KSVEVPKESS SLVQYDLIGQ TVSSETIKSI TGEYIVMTVY FHLRRKMGYF   240
MIQTYIPCIM TVILSQVSFW INKESVPART VFGITTVLIM TTLSISARHS LPKVSYATAM   300
DWFIAVCFAF VFSALIEFAA VNYFTNIQME KAKRKTSKPP QEVPAAPVQR EKHPEAPLQN   360
TNANLNMRKR TNALVHSESD VGNRTEVGNH SSKSSTVVQE SSKGTPRSYL ASSPNPFSRA   420
NAAETISAAR ALPSASPTSI RTGYMPRKAS VGSASTRHVF GSRLQRIKTT VNTIGATGKL   480
SATPPPSAPP PSGSGTSKID KYARILFPVT FGAFNMVYWV VYLSKDTMEK SESLM        535
```

SEQ ID NO: 152 Human gamma-aminobutyric acid type A receptor alpha4
  subunit (GABRA4) amino acid sequence, isoform 3 (NP_001191196.1)

```
MLQRWFLPRS LNESPGQNQK EEKLCTENFT RILDSLLDGY DNRLRPGFGG PVTEVKTDIY    60
VTSFGPVSDV EMEYTMDVFF RQTWIDKRLK YDGPIEILRL NNMMVTKVWT PDTFFRNGKK   120
SVSHNMTAPN KLFRIMRNGT ILYTMRLTIS AECPMRLVDF PMDGHACPLK FGSYAYPKSE   180
```

TABLE 2-continued

```
MIYTWTKGPE KSVEVPKESS SLVQYDLIGQ TVSSETIKSI TGITTVLTMT TLSISARHSL    240
PKVSYATAMD WFIAVCFAFV FSALIEFAAV NYFTNIQMEK AKRKTSKPPQ EVPAAPVQRE    300
KHPEAPLQNT NANLNMRKRT NALVHSESDV GNRTEVGNHS SKSSTVVQES SKGTPRSYLA    360
SSPNPFSRAN AAETISAARA LPSASPTSIR TGYMPRKASV GSASTRHVFG SRLQRIKTTV    420
NTIGATGKLS ATPPPSAPPP SGSGTSKIDK YARILFPVTF GAFNMVYWVV YLSKDTMEKS    480
ESLM                                                                484
```

SEQ ID NO: 153 Mouse gamma-aminobutyric acid type A receptor alpha4 subunit (GABRA4) cDNA (NM_010251.2)

```
atggtttctg tccagaaggt acccgcgatt gcgctgtgct ccggggtcag cctcgccctc     60
ctgcacttcc tgtgcctggc ggcttgttta aacgaatccc caggacagaa ctcaaaggac    120
gagaaattgt gcccgaaaa ttttacccgt attctgacta gtttgctgga tggttatgac    180
aacaggctgc gtcctggatt tggggggtcct gttacagaag tgaaaactga tatatatgtc    240
accagctttg ggcccgtttc tgatgttgaa atggaataca ctatggatgt gttcttcaga    300
cagacatgga ttgacaaaag actaaaatat gacggcccaa ttgaaatctt gaggctgaat    360
aatatgatgg tcaccaaagt ttggaccect gatactttct tcaggaatgg aaagaaatct    420
gtctcacata acatgacagc tccaaataag cttttagaa ttatgagaaa tggcactatt     480
ttatacacaa tgagactcac cataagtgcg gagtgcccca tgagactggt ggatttcct     540
atggatggtc atgcctgccc tttgaaattt ggagtttatg catatcccaa aagtgagatg    600
atctcacect ggaccaaagg ccctgagaag tcagtgagg tgccaaagga gtcttctagc    660
ttagttcaat atgaccicat tgggcagact gtatcaagcg agactatcaa atctattaca    720
ggtgaataca ttgttatgac ggtttacttc cacctcagac ggaagatggg ctactttatg    780
attcagacgt atatcccatg catcatgaca gtgattcttt ctcaagtttc cttctggata    840
aacaaggagt ctgttccagc tagaactgta tttggaataa ccacagtcct cacgatgacc    900
accctaagca tcagtgctcg gcattctttg cccaaagtgt cctatgcgac tgccatggat    960
tggttcatag ctgtctgttt tgcttttgta ttttcggctc ttattgagtt tgctgctgtc   1020
aactatttca ccaacattca aatgcagaaa gccaaaaaga gatatcaaa gcctcccca     1080
gaagttccag ctgctcctgt gctgaaggag aaacacacag aaacatccct tcagaataca    1140
catgccaatt tgaactgag gaaaagaaca aatgccttgg tccattcaga atcggatgtc    1200
aaagcagaa ctgaggtggg aaatcactcc agcaagacca gcgctgtcca ggagtcttct    1260
gaagccacgc ctaaggctca cttagcttcc agtccaaatc cattcagcag ggcaaatgca    1320
gctgagacta tgtctgctgc agccagaggt ctttcatctg cagcatcccc ctctcctcat    1380
ggcacattgc ggccagcttc tttggggtca gcttccaatc gccctgcatt tggatctaga    1440
cttgggcgaa ttaagacaac agttaataca acaggggctg ctgggaatgt gtcagccaca    1500
cctcctcccc ctgctccacc gccttctgga tctggcacaa gtaaaataga caaatatgct    1560
cgtattctct ttccagtcac atttggagca tttaacatgg tctactgggt tgtttattta    1620
tctaaggaca ccatggagaa atcagaaagt ctaatgtaa                           1659
```

SEQ ID NO: 154 Mouse gamma-aminobutyric acid type A receptor alpha4 subunit (GABRA4) amino acid sequence (NP_034381.1)

```
MVSVQKVPAI ALCSGVSLAL LHFLCLAACL NESPGQNSKD EKLCPENFTR ILDSLLDGYD     60
NRLRPGFGGP VTEVKTDIYV TSFGPVSDVE MEYTMDVFFR QTWIDKRLKY DGPIEILRLN    120
NMMVTKVWTP DTFFRNGKKS VSHNMTAPNK LFRIMRNGTI LYTMRLTISA ECPMRLVDFP    180
MDGHACPLKF GSYAYPKSEM IYTWTKGPEK SVEVPKESSS LVQYDLIGQT VSSETIKSIT    240
GEYIVMTVYF HLRRKMGYFM IQTYIPCIMT VILSQVSFWI NKESVPARTV FGITTVLTMT    300
TLSISARHSL PKVSYATAMD WFIAVCFAFV FSALIEFAAV NYFTNIQMQK AKKKISKPPP    360
EVPAAPVLKE KHTETSLQNT HANLNMRKRT NALVHSESDV KSRTEVGNHS SKTSAVQESS    420
EATPKAHLAS SPNPFSRANA AETMSAAARG LSSAASPSPH GTLRPASLGS ASTRPAFGSR    480
LGRIKTTVNT TGAAGNVSAT PPPPAPPPSG SGTSKIDKYA RILFPVTFGA FNMVYWVVYL    540
SKDTMEKSES LM                                                        552
```

SEQ ID NO: 155 Human phosphatidylinositol 4-kinase type 2 alpha (PI4K2A), cDNA (NM_018425.3)

```
atggacgaga cgagcccact agtgtccccc gagcgggccc aaccccggga ctacaccttc     60
ccgtcgggct cgggcgctca ctttccgcag gtgcccgggg gcgcggtccg agtggcggcg    120
gcggccgagt cgggcccctc tccgccgggc tcgccggccc acgaccgcga gcgcagcca    180
ctgttggatc gggcccgggg cgcggcggcc cagggccaga cccaaaccgt ggcggcgcag    240
gcccaggctc tggccgctca ggccgcgcg gcagcccacg ccgctcaggc ccaccgcgag    300
cggaacgagt tcccggagga tcctgagttc gaggcggtgg tgcggcaggc cgagctggcc    360
atcgagcgct gcatctttcc cgagcgcatc taccagggcc ccagcggaa ctacttcgtc    420
aaggaccctc aggggaggat cattgctgtc ttcaaaccca agaatgaaga gccctatggg    480
catcttaatc ctaagtggac caagtggctg cagaagctgt gctgtccttg ctgctttggc    540
cgtgactgcc ttgtccttaa ccagggctat ctctcagaag caggggccag cctggtggac    600
caaaaactgg aactcaacat tgttccccgt acaaaggtag tataccttgc cagtgagacc    660
ttcaactata gtgccattga ccgagtgaag tccaggggca gcggcttgc actagagaaa    720
gtgccaaaag ttggacagcg gtttaaccgc atcgggctac accaaaaggt tggttcattc    780
cagctctttg ttgaaggcta caagatgca gactattggc tgcggcgttt tgaagcagaa    840
cctcttcctg agaacactaa ccggcaacta ctgctccagt ttgagcggtt ggtggtgtca    900
gattacatca tccgcaacac tgatcgaggc aatgacaact ggctgattaa atatgactgt    960
ccaatggata gttctagctc tcgggacaca gactgggtgg tgtgaagga gctgttatc    1020
aaggtggctg ccatagacaa tggctgggcc ttcccactga gcatcctga ctcctggagg    1080
gcatatcctt ttactgggc ctggttgccc caggcgaaaa tcccattttg tcaagatatc    1140
aaagatctga tccttccaa gatatcggac cctaacttcg tcaaggactt ggaagaggac    1200
ctatatgaac tcttcaagaa agatcctggt ttcgacaggg gccagttcca taagcagatt    1260
gctgtcatgc ggggccagat cttaaatctg acccaggcct tgaaagacaa caagagtccc    1320
ctgcacctcg tccagatgcc acctgtgatt gtcgagacgc cgttcccca ccagcggtct    1380
tctagcgagt cctacacaca gagctttcag agccggaagc cctttctttc atggtggtag    1440
```

TABLE 2-continued

SEQ ID NO: 156 Human phosphatidylinositol 4-kinase type 2 alpha
(PI4K2A) amino acid sequence (NP_060895.1)

```
MDETSPLVSP ERAQPPDYTT PSGSGAHFPQ VPGGAVRVAA AAGSGPSPPG SPGHDRERQP      60
LLDRARGAAA QGQTQTVAAQ AQALAAQAAA AAHAAQAHRE RNEFPEDPEF EAVVRQAELA     120
IERCIFPERI YQGSSGSYFV KDPQGRIIAV FKPKNEEPYG HLNPKWTKWL QKLCCPCCFG     180
RDCLVLNQGY LSEAGASLVD QKLELNIVPR TKVVYLASET FNYSAIDRVK SRGKRLALEK     240
VPKVGQRFNR IGLPPKVGSF QLFVEGYKDA DYWLRRFEAE PLPENTNRQL LLQFERLVVL     300
DYIIRNTDRG NDNWLIKYDC PMDSSSSRDT DWVVVKEPVI KVAAIDNGLA FPLKHPDSWR     360
AYPFYWAWLP QAKVPFSQEI KDLILPKISD PNFVKDLEED LYELFKKDPG FDRGQFHKQI     420
AVMRGQILNL TQALKDNKSP LHLVQMPPVI VETARSHQRS SSESYTQSFQ SRKPFFSWW      479
```

SEQ ID NO: 157 Mouse phosphatidylinositol 4-kinase type 2 alpha
(PI4K2A) cDNA (NM_145501.2)

```
atggacgaga cgagcccgct agtgtccccc gagcgggccc aaccccggga gtacaccttc      60
ccgtcgggct ccggagctca cttccgcaa gtaccggggg gcgcggtccg cgtggcggcg     120
gcggccggct ccggcccgtc accgccgtgc tcgcccggcc acgaccggga gcggcagccc     180
ctgctggacc gggcccgggg cgcggcggcg cagggccaga cccacacggt ggcggtgcag     240
gccaggccc tggccgccca agcggccgtg gcggcgcaca ccgttcagac ccaccgcgag     300
cggaacgact tcccggagga ccccgagttc gaggtggtgg tgcggcaggc cgaggttgcc     360
atcgagtgca gcatctatcc cgagcgcatc taccagggct ccagtggaag ctacttcgtc     420
aaggactctc aggggagaat cgttgctgtc ttcaaaccca agaatgaaga gccatacggg     480
caccttaacc ctaagtggac caagtggctg cagaagctgt gctgccctg ctgctttgg      540
cgagactgcc ttgttctcaa cagggctat ctctcagagg caggggctag cctggtggac     600
caaaaactgg aactcaacat tgtaccacgt acaaaggtag tatacctggc cagtgaaacc     660
ttcaactaca gtgccattga tcgagtaaag tccaggggca agcggcttgc actagagaaa     720
gtgccaaaag ttgggcagcg gtttaaccga atcggcctgc caccaaaggt cggtgcattc     780
cagctcttcg ttgaaggcta caaagatgca gactattgc tgcggcgttt tgaagcagaa     840
cctctccctg agaacacgaa ccgacagctg ctattgcagt ttgagcggtt ggtggtcctg     900
gactacatca tccgcaacac tgaccgaggc aatgacaact ggttgatcaa atatgactgt     960
ccgatggata attctagctg tcgggacaca gattgggtga tggtgaggga gcctgttatc    1020
aaggtggctg ccatagacaa cgggctagct ttcccactga agcatcctga ctcctggagg    1080
gcatatcctt tttactgggc ctggctgcct caggcgaaag tcccgttctc tcaggagatc    1140
aaagatttga ttcttccaaa gatttcagac cctaacttca tcaaggactt ggaggaggac    1200
ctatatgaac tcttcaagag agatcctggc ttcgacaggg gccagttcca taagcagatt    1260
gctgtcatga gaggccagat cctaaatttg acccaggccc tgaaagacaa taagagcccc    1320
ctgcacctcg tccagatgcc acctgtgatt gtcgagacgg cccgctctca ccagcggtct    1380
gcaagcgaat cctacacaca gagctttcag agtcggaagc ccttcttttc atggtggtag    1440
```

SEQ ID NO: 158 Mouse phosphatidylinositol 4-kinase type 2 alpha
(PI4K2A) amino acid sequence (NP_663476.1)

```
MDETSPLVSP ERAQPPEYTF PSGSGAHFPQ VPGGAVRVAA AAGSGPSPPC SPGHDRERQP      60
LLDRARGAAA QGQTHTVAVQ AQALAAQAAV AAHAVQTHRE RNDFPEDPEF EVVVRQAELA     120
IECSIYPERI YQGSSGSYFV KDSQGRIVAV FKPKNEEPYG HLNPKWTKWL QKLCCPCCFG     180
RDCLVLNQGY LSEAGASLVD QKLELNIVPR TKVVYLASET FNYSAIDRVK SRGKRLALEK     240
VPKVGQRFNR IGLPPKVGSF QLFVEGYKDA DYWLRRFEAE PLPENTNRQL LLQFERLVVL     300
DYIIRNTDRG NDNWLIKYDC PMDNSSCRDT DWVMVREPVI KVAAIDNGLA FPLKHPDSWR     360
AYPFYWAWLP QAKVPFSQEI KDLILPKISD PNFIKDLEED LYELFKRDPG FDRGQFHKQI     420
AVMRGQILNL TQALKDNKSP LHLVQMPPVI VETARSHQRS ASESYTQSFQ SRKPFFSWW      479
```

SEQ ID NO: 159 Human phosphatidylinositol 3-kinase regulatory
subunit beta (PIK3R2), cDNA (NM_005027.3)

```
atggcgggcc ctgagggctt ccagtaccgc gctctgtacc cgttccgccg ggagcggccg      60
gaggacctgg agctgctgcc cggcgacgtg ctggtagtga gccggcggc cttgcaggcg     120
ctgggctgg ccgagggtgg cgagcgctgc ccacagacgg tgggctggat gcccggcctc     180
aacgagcgca cacggcagcg aggtgacttc cctggcacct atgtggagtt cctggggccc     240
gtggccctgg cccggcccgg ccctcgccca cggggccccc gccactgcc cgccaggccc     300
cgtgatgggg cccctgagcc aggcctcaca ctccccgact gcccgagca gttctcccca     360
cctgatgtgg ctccccctct tctggtgaag ctttgtgagg ccattgaaag gacagggctg     420
gacagcgaat tcactaccg cccggagctg cccgcaccgc gtacagactg gtccctgagc     480
gacgtggatc agtgggacac ggcagccctg gctgacggca ttaagagctt cctgctggca     540
ctgccccgcg cgctcgtgac ccccgaggcc tcggccgagg cgcgccggc cctgcgggag     600
gccgcgggcc cgtggggcc ggcgctgag ccaccgacgg tgcgctgca ccgcgcgctc     660
acgctgcgct tcctgctcca gcacctgggc cgcgtggccc gccgcgcccc ggccctgggt     720
cccgcggtcc gggcccgtgg cgccacctttt ggccgctgc tgctgcgcgc gccgccgccg     780
ccgtcctcgc cgccgccagg gggcgctccc gacgggagtg agcccagccc tgacttcccg     840
gcgctgctgg tggagaagct gcttcaggaa cacttggaag agcagggagt tgcgccccca     900
gcgctgccgc ctaaaccccc caaggcaaag ccggccccca gtcctggcc aatggaggg     960
agcccacccc ccctgcagga tgctgagtgg tactgggggg acatttcaag ggaggaggtg    1020
aacgagaaac tccgggacac tccgatggc accttcctag tccgagatgc ttctagcaag    1080
gccaggcgg agtacacgct gacccctcag aaaggcggaa acaataagct gatcaaggtc    1140
ttccaccgag atgggcacta tggcttctca gagccactca cctgctgctc cgttgtggac    1200
ctcatcaatc actaccgcca cgagtctctg gcccagtaca atgccaagct ggacacacgg    1260
ctcctctacc ctgtgtccaa ataccagcag gaccagattg tcaaggagga cagcgtggaa    1320
gcagtgggcg cccagcttaa ggtctatcac cagcagtacc aggacaagag ccgcgagtat    1380
gaccagcttt atgaagagta cacacggacc tcccaggagc tgcagatgaa gcgtactgca    1440
```

TABLE 2-continued

```
attgaggcct tcaatgagac tatcaagatc tttgaagagc agggccagac tcaagagaaa    1500
tgcagcaagg aatacctgga gcgcttccgg cgtgagggca acgagaaaga gatgcaaagg    1560
atcctgctga actccgagcg gctcaagtcc cgcattgccg agatccatga gagccgcacg    1620
aagctggagc agcagctgcg ggcccaggcc tcggacaaca gagagatcga caagcgcatg    1680
aacagcctca agccggacct catgcagctg cgcaagatcc gagaccagta cctcgtgtgg    1740
ctcacccaga aaggcgcccg gcagaagaaa atcaacgagt ggctggggat taaaaatgag    1800
actgaggacc agtacgcact catggaggac gaggacgatc tcccgcacca cgaggaacgc    1860
acttggtacg tgggcaagat caaccgcacg caggcagagg agatgctgag tggcaagcgg    1920
gatggcacct tcctcatccg cgagagcagc cagcgggct gctacgcctg ctccgtggta    1980
gtggacggca acaccaagca ctgcgtcatc taccgcacgg ccaccggctt cggcttcgcg    2040
gagccctaca acctgtacgg gtcgctgaag gagctggtgc tgcactacca gcacgcctcg    2100
ctggtgcagc acaacgacgc gctcaccgtc accctggcgc acccagtgcg cgccccgggc    2160
cccggcccgc cgcctgccgc cgctga                                         2187
```

SEQ ID NO: 160 Human phosphatidylinositol 3-kinase regulatory
subunit beta (PIK3R2) amino acid sequence (NP_005018.1)

```
MAGPEGFQYR ALYPFRRERP EDLELLPGDV LVVSRAALQA LGVAEGGERC PQSVGWMPGL     60
NERTRQRGDF PGTYVEFLGP VALARPGPRP RGPRPLPARP RDGAPEPGLI LPDLPEQFSP    120
PDVAPPLLVK LVEAIERTGL DSESHYRPEL PAPRTDWSLS DVDQWDTAAL ADGIKSFLLA    180
LPAPLVTPEA SAEARRALRE AAGPVGPALE PPTLPLHRAL TLRFLLQHLG RVARRAPALG    240
PAVRALGATF GPLLLRAPPP PSSPPPGGAP DGSEPSPDFP ALLVEKLLQE HLEEQEVAPP    300
ALPPKPPKAK PAPTVLANGG SPPSLQDAEW YWGDISREEV NEKLRDTPDG TFLVRDASSK    360
IQGEYTLTLR KGGNNKLIKV FHRDGHYGFS EPLTFCSVVD LINHYRHESL AQYNAKLDTR    420
LLYPVSKYQQ DQIVKEDSVE AVGAQLKVYH QQYQDKSREY DQLYEEYTRT SQELQMKRTA    480
IEAFNETIKI FEEQGQTQEK CSKEYLERFR REGNEKEMQR ILLNSERLKS RIAEIHESRT    540
KLEQQLRAQA SDNREIDKRM NSLKPDLMQL RKIRDQYLVW LTQKGARQKK INEWLGIKNE    600
TEDQYALMED EDDLPHHEER TWYVGKINRT QAEEMLSGKR DGTFLIRESS QRGCYACSVV    660
VDGDTKHCVI YRTATGEGFA EPYNLYGSLK ELVLHYQHAS LVQHNDALTV TLAHPVRAPG    720
PGPPPAAR                                                             728
```

SEQ ID NO: 161 Mouse phosphatidylinositol 3-kinase regulatory
subunit beta (PIK3R2) cDNA (NM_008841.2)

```
atggcaggag ccgagggctt ccagtacagg gctgtgtacc cattccgccg ggagcggcct     60
gaagacctgg agctgctccc tggggacctc ctggtggtga gccgggtggc cctacaggca    120
cttggtgtgg ctgatggagg agagcgctgc ccacacaatg tgggctggat gcctggcttc    180
aacgaggaca cccgacagcg aggggacttc cccgggacat acgtggagtt cctaggaccc    240
gtggctctgg ctcgaccagg ccctcgccca cggggggccc gtccgttgcc cgccaggccc    300
ttggatggat cttctgagtc aggccacata ctcccagacc tggcagagca gttctcccca    360
cctgaccctg ctcccccgat tctggtgaag ctggtggaag ccattgagca agcagagctg    420
gacagtgaat gctacagtaa gccggagctg cccgcaacac gtgacagctg gtccctgagt    480
gacttggagc agtgggaccg caccgccttg tatgatgctg ttaagggctt cctgctggcg    540
ttgcctgcag ctgtggtgac ccctgaagct gcagcagagg cgtaccgggc acttcgagag    600
gttgcaggcc ccgtggggct ggtgctgaaa cccccaacac tgccgctgca ccaggctctc    660
acactgcgtt tcctgctgca cacacctggg tcgtgtgccg acagagccc ctcgccagat    720
acagctgtcc atgcactggc cagtgccttc gggccgctac tgctgcgcat acctccgtca    780
ggggggcgagg tgatgggag tgagcctgta cccgacttcc ctgtgctgct gctagagagg    840
ctggtgcagg agcatgtgga ggagcaagac gctgccccc cagcgctacc acctaagccc    900
tctaaggcaa agccggcacc cacagctctg gccaatggag gaccccgacc ctcgcttcag    960
gatgcagagt ggtactgggg ggacatctcc agggaagagg tgaatgagag actccgggac   1020
acacctgatg gtaccttctt agtcagagat gcatccagca agatcaagg agagtacacg   1080
ctcaccctca ggaaaggcgg gaacaacaag ttgatcaaag tcttccaccg ggatggtcac   1140
tatgccttct cagagcccct tacccttctgc tccgtggtga aactcatctc ccactaccgc   1200
cacgaatcac tggcccagta caacgccaag ctggacacga gccttctcta ccctgtgtcc   1260
aagtaccaac aagaccaggt ggtgaaggag gacagcatag aggctgtggg cgcccagctc   1320
aaggtctacc accagcagta ccaggacaag agccgcgaat atgaccagct gtatgaagaa   1380
tacacacgga cctcccagga gctgcagatg aagcgcacag ccatagaggc cttcaacgag   1440
accatcaaga tcttcgaaga gcagggccag acacaggaga aatgcagcaa ggagtatttg   1500
gagcgcttcc ggcgagaggg aaatgagaag gagatgcaga ggatcctgct gaactccgag   1560
cgactcaagt ctcgcatcgc ggagatacac gaaagccgca cgaagttgga gcaggatctg   1620
cgggcgcagg cctccgacaa ccgtgagatc gacaagcgca tgaacagcct caaacctgac   1680
ctcatgcagc tgcgcaagat cagggaccag taccttcgtg ggctcaccca gaaaggtgcc   1740
cgacagagga agatcaacga atggctggga atcaagaacg agactgagga ccagtattca   1800
ctgatggagg atgaggacgc cctccccac acgaggagc gcacgtggta cgtgggcaag   1860
atcaaccgca cacaggcgga ggagatgctg agtggcaaac gagacgggac cttcctcatc   1920
cgggagcagc gcagcgggg ctgttacgca tgctccgtgg tggtgacgg cgacacgaag   1980
cactgtgtca tctaccgcac agccaccggc ttcggcttcg cagagcccta taacctgtac   2040
gggtccctga aggagctggt gctgcactac cagcacgcat cactcgtgca gcacaatgac   2100
gcacttaccg tcaccctcgc acaccctgtg cgtgcccccg ggcctggccc accgtctgca   2160
gcacgctga                                                            2169
```

SEQ ID NO: 162 Mouse phosphatidylinositol 3-kinase regulatory subunit
beta (PIK3R2) amino acid sequence (NP_032867.2)

```
MAGAEGFQYR AVYPFRRERP EDLELLPGDL LVVSRVALQA LGVADGGERC PHNVGWMPGF     60
NERTRQRGDF PGTYVEFLGP VALARPGPRP RGPRPLPARP LDGSSESGHI LPDLAEQFSP    120
PDPAPPILVK LVEAIEQAEL DSECYSKPEL PATRTDWSLS DLEQWDRTAL YDAVKGFLLA    180
LPAAVVTPEA AAEAYRALRE VAGPGLVLE PPTLPLHQAL TLRFLLQHLG RVARRAPSPD    240
TAVHALASAF GPLLLRIPPS GGEGDGSEPV PDFPVLLLER LVQEHVEEQD AAPPALPPKP    300
```

TABLE 2-continued

```
SKAKPAPTAL ANGGSPPSLQ DAEWYWGDIS REEVNERLRD TPDGTFLVRD ASSKIQGEYT    360
LTLRKGGNNK LIKVPHRDGH YGESEPLTFC SVVELISHYR HESLAQYNAK LDTRLLYPVS    420
KYQQDQVVKE DSIEAVGAQL KVYHQQYQDK SREYDQLYEE YTRTSQELQM KRTAIEAFNE    480
TIKIFEEQGQ TQEKCSKEYL ERFRREGNEK EMQRILLNSE RLKSRIAEIH ESRTKLEQDL    540
RAQASDNREI DKRMNSLKPD LMQLRKIRDQ YLVWLTQKGA RQRKINEWLG IKNETEDQYS    600
LMEDEDALPH HEERTWYVGK INRTQAEEML SGKRDGTFLI RESSQRGCYA CSVVVDGDTK    660
HCVIYRTATG FGFAEPYNLY GSLKELVLHY QHASLVQHND ALTVTLAHPV RAPGPGPPSA    720
AR                                                                   722
```

SEQ ID NO: 163 Human cholinergic receptor nicotinic alpha 1 subunit
(CHRNA1) cDNA, transcript variant 1 (NM_001039523.2)

```
atggagccct ggcctctcct cctgctcttt agcctttgct cagctggcct cgtcctgggc     60
tccgaacatg agacccgtct ggtggcaaag ctatttaaag actacagcag cgtggtgcgg    120
ccagtggaag accaccgcca ggtcgtggag gtcaccgtgg gcctgcagct gatacagctc    180
atcaatgtgg atgaagtaaa tcagatcgtg acaaccaatg tgcgtctgaa acagggtgac    240
atggtagatc tgcccacgcc cagctgcgtg actttgggag ttcctttgtt ttctcatctg    300
cagaatgagc aatgggtgga ttacaaccta aaatggaatc cagatgacta tggcggtgtg    360
aaaaaaattc acattccttc agaaaagatc tggcgcccag accttgttct ctataacaat    420
gcagatggtg actttgctat tgtcaagttc accaaagtgc tcctgcagta cactggccac    480
atcacgtgga caccttccagc catctttaaa agctactgtg agatcatcgt cacccacttt    540
cccttttgatg aacagaactg cagcatgaag ctgggcacct ggacctacga cggctctgtc    600
gtggccatca cccggaaag cgaccagcca gacctgagca cttcatggag gagcggggag    660
tgggtgatca aggagtcccg gggctggaag cactccgtga cctattcctg ctgccccgac    720
accccctacc tggacatcac ctaccacttc gtcatgcagc gcctgcccct ctacttcatc    780
gtcaacgtca tcatcccctg cctgctcttc tccttcttaa ctggcctggt attctacctg    840
cccacagact caggggagaa gatgactctg agcatctctg tcttactgtc tttgactgtg    900
ttccttctgg tcatcgtgga gctgatcccc tccacgtcca gtgctgtgcc cttgattgga    960
aaatacatgc tgttcaccat ggtgttcgtc attgcctcca tcatcatcac tgtcatcgtc   1020
atcaacacac accaccgctc acccagcacc catgtcatgc ccaactgggt gcggaaggtt   1080
tttatcgaca ctatcccaaa tatcatgttt ttctccacaa tgaaaagacc atccagagaa   1140
aagcaagaca aaaagatttt tacagaagac attgatatct ctgacatttc tggaaagcca   1200
gggcctccac ccatgggctt ccactctccc ctgatcaaac ccccgaggt gaaagtgcc    1260
atcgaggca tcaagtacat cgcagagacc atgaagtcag accaggagtc taacaatgcg   1320
gcggcagagt ggaagtacgt tgcaatggtg atggaccaca tactcctcgg agtcttcatg   1380
cttgtttgca tcatcggaac cctagccgtg tttgcaggtc gactcattga attaaatcag   1440
caaggatga                                                           1449
```

SEQ ID NO: 164 Human cholinergic receptor nicotinic alpha 1 subunit
(CHRNA1) cDNA, transcript variant 2 (NM_000079.3)

```
atggagccct ggcctctcct cctgctcttt agcctttgct cagctggcct cgtcctgggc     60
tccgaacatg agacccgtct ggtggcaaag ctatttaaag actacagcag cgtggtgcgg    120
ccagtggaag accaccgcca ggtcgtggag gtcaccgtgg gcctgcagct gatacagctc    180
atcaatgtgg atgaagtaaa tcagatcgtg acaaccaatg tgcgtctgaa acagcaatgg    240
gtggattaca acctaaaatg gaatccagat gactatggcg gtgtgaaaaa aattccacatt    300
ccttcagaaa agatctggcg cccagacctt gttctctata acaatgcaga tggtgacttt    360
gctattgtca agttcaccaa agtgctcctg cagtacactg ccacatcac gtggacacct    420
ccagccatct ttaaaagcta ctgtgagatc atcgtcaccc actttccctt tgatgaacag    480
aactgcagca tgaagctggg cacctggacc tacgacggct ctgtcgtggc catcaacccg    540
gaaagcgacc agccagacct gagcaacttc atggagagcg gggagtgggt gatcaaggag    600
tcccgggggct ggaagcactc cgtgacctat tcctgctgcc ccgacacccc ctacctggac    660
atcacctacc acttcgtcat gcagcgcctg cccctctact tcatcgtcaa cgtcatcatc    720
ccctgcctgc tcttctcctt cttaactggc tggtattct acctgccac agactcaggg    780
gagaagatga ctctgagcat ctctgtctta ctgtctttga ctgtgttcct tctggtcatc    840
gtggagctga tcccctccac gtccagtgct gtgcccttga ttggaaaata catgctgttc    900
accatggtgt tcgtcattgc ctccatcatc atcactgtca tcgtcatcaa cacacaccac    960
cgctcaccca gcacccatgt catgcccaac tgggtgcgga aggttttat cgacactatc   1020
ccaaatatca tgttttctc cacaatgaaa gaccatcca gagaaaagca agacaaaaag   1080
atttttacag aagacattga tatctctgac atttctggaa agccagggcc tcacccatg    1140
ggcttccact ctcccctgat caaacaccccc gaggtgaaaa gtgccatcga ggcatcaag   1200
tacatcgcag agaccatgaa gtcagaccag gagtctaaca atgcggcgg cagagtggaag   1260
tacgttgcaa tggtgatgga ccacatactc ctcggagtct tcatgcttgt ttgcatcatc   1320
ggaaccctag ccgtgtttgc aggtcgactc attgaattaa atcagcaagg atga         1374
```

SEQ ID NO: 165 Human cholinergic receptor nicotinic alpha 1 subunit
(CHRNA1) amino acid sequence, isoform a (NP_001034612.1)

```
MEPWPLLLLF SLCSAGLVLG SEHEIRLVAK LFKDYSSVVR PVEDHRQVVE VTVGLQLIQL     60
INVDEVNQIV TTNVRLKQGD MVDLPRPSCV TLGVPLFSHL QNEQWVDYNL KWNPDDYGGV    120
KKIHIPSEKI WRPDLVLYNN ADGDFAIVKF TKVLLQYTGH ITWIPPATFK SYCEIIVTHF    180
PFDEQNCSMK LGTWTYDGSV VAINPESDQP DLSNFMESGE WVIKESRGWK HSVTYSCCPD    240
TPYLDITYHF VMQRLPLYFI VNVIIPCLLF SFLTGLVFYL PTDSGEKMTL SISVLLSLTV    300
FLLVIVELIP STSSAVPLIG KYMLFTMVEV IASIIITVIV INTHHRSPST HVMPNWVRKV    360
FIDTIPNIMF FSTMKRPSRE KQDKKIFTED IDISDISGKP GPPMGFHSP LIKHPEVKSA    420
IEGIKYIAET MKSDQESNNA AAEWKYVAMV MDHILLGVFM LVCIIGTLAV FAGRLIELNQ    480
QG                                                                   482
```

TABLE 2-continued

SEQ ID NO: 166 Human cholinergic receptor nicotinic alpha 1 subunit
(CHRNA1) amino acid sequence, isoform b (NP_000070.1)

```
MEPWPLLLLF SLCSAGLVLG SEHETRLVAK LFKDYSSVVR PVEDHRQVVE VTVGLQLIQL      60
INVDEVNQIV TTNVRLKQQW VDYNLKWNPD DYGGVKKIHI PSEKIWRPDL VLYNNADGDF     120
AIVKFTKVLL QYTGHITWTP PATFKSYCEI IVTHFPFDEQ NCSMKLGTWT YDGSVVAINP    180
ESDQPDLSNF MESGEWVIKE SRGWKHSVTY SCCPDTPYLD ITYHFVMQRL PLYFIVNVII    240
PCLLFSFLTG LVFYLPTDSG EKMTLSISVL LSLTVFLLVI VELIPSTSSA VPLIGKYMLF    300
TMVFVIASII ITVIVINTHH RSPSTHVMPN WVRKVFIDTI PNIMFFSTMK RPSREKQDKK    360
IFTEDIDISD ISGKPGPPPM GFHSPLIKHP EVKSAIEGIK YIAETMKSDQ ESNNAAAEWK    420
YVAMVMDHIL LGVFMLVCII GTLAVFAGRL IELNQQG                             457
```

SEQ ID NO: 167 Mouse cholinergic receptor nicotinic alpha 1 subunit
(CHRNA1) cDNA (NM_007389.5)

```
atggagctct cgactgttct cctgctgcta ggcctctgct ccgctggcct tgttctgggc     60
tccgaacatg agacgcgtct ggtggcaaag ctctttgaag actacagcag tgtagtccgg    120
ccagtggagg accaccgtga gattgtacaa gtcaccgtgg gtctacagct gatccagctt    180
atcaatgtgt atgaagtaaa tcagattgtg acaaccaatg tacgtctgaa acagcaatgg    240
gtcgattaca acttgaaatg gaatccagat gactatggag gagtgaaaaa aattcacatc    300
ccctcggaaa agatctggcg gccggacgtc gttctctata acaacgcaga cggcgacttt    360
gccattgtca aattcaccaa ggtgctcctg gactacaccg gccacatcac ctggacaccg    420
ccagccatct ttaaaagcta ctgtgagatc attgtcactc actttccctt cgatgagcag    480
aactgcagca tgaagctggg cacctggacc tatgacggct ctgtggtggt cattaaccgg    540
gaaagtgacc agcccgacct gagtaacttc atggagagcg gggagtgggt gatcaaggaa    600
gctcggggct ggaagcactg ggtgttctac tcctgctgcc ccaccactcc ctacctggac    660
atcacctacc acttcgtcat gcagcgcctg cccctctact tcattgtcaa cgtcatcatt    720
ccctgcctgc tcttctcctt cttaaccagc ctggtgttct acctgcccac agactcaggg    780
gagaagatga cgctgagcat tctgtcttca ctgtccctga ccgtgttcct tctggtcatt    840
gtggagctaa tccccttcca ctccagcgct gtgcccctga tcgggaagta tatgttgttc    900
accatggtct ttgtcattgc gtccatcatc atcaccgtca tcgtcatcaa cacacaccac    960
cgttcgccca gcacccacat catgcccgag tgggtgcgga aggttttat cgacactatc   1020
ccaaacatca tgttttttctc cacaatgaaa agaccatccg gagataaaca agagaaaagg   1080
attttttacag aagacataga tatatctgac atctctggga agccgggtcc tccacctatg   1140
ggctttcact ctccgctgat caagcaccct gaggtgaaaa gcgccatcga gggcgtgaag   1200
tacattgcag agaccatgaa gtcagaccag gagtccaata acgccgctga ggaatggaag   1260
tatgttgcca tggtgatgga tcacatcctc ctcggagtct tatgctggt gtgtctcatc   1320
gggacgctgg ctgtgtttgc aggtcggctc attgagttac atcaacaagg atga           1374
```

SEQ ID NO: 168 Mouse cholinergic receptor nicotinic alpha 1 subunit
(CHRNA1) amino acid sequence (NP_031415.2)

```
MELSTVLLLL GLCSAGLVLG SEHETRLVAK LFEDYSSVVR PVEDHREIVQ VTVGLQLIQL      60
INVDEVNQIV TTNVRLKQQW VDYNLKWNPD DYGGVKKIHI PSEKIWRPDV VLYNNADGDF    120
AIVKFTKVLL DYTGHITWTP PAIFKSYCEI IVTHFPFDEQ NCSMKLGTWT YDGSVVAINP    180
ESDQPDLSNF MESGEWVIKE ARGWKHWVFY SCCPTTTYLD ITYHFVMQRL PLYFIVNVII    240
PCLLFSFLTS LVFYLPTDSG EKMTLSISVL LSLTVFLLVI VELIPSTSSA VPLIGKYMLF    300
TMVFVIASII ITVIVINTHH RSPSTHIMPE WVRKVFIDTI PNIMFFSTMK RPSRDKQEKR    360
IFTEDIDISD ISGKPGPPPM GFHSPLIKHP EVKSAIEGVK YIAETMKSDQ ESNNAAEEWK    420
YVAMVMDHIL LGVFMLVCLI GTLAVFAGRL IELHQQG                             457
```

SEQ ID NO: 169 Human N-acetylglucosamine-1-phosphodiester alpha-N-
acetylglucosaminidase (NAGPA), cDNA (NM_016256.3)

```
atggcgacct ccacgggtcg ctggcttctc ctccggcttg cactattcgg cttcctctgg     60
gaagcgtccg gcgcctcga ctcggggggcc tcccgcacgg acgactttgct actgccctat    120
ccacgcgcgc gcgcgcgcct ccccccggac tgcacacggg tgcgcgccgg caaccgcgag    180
cacgagagtt ggcctccgcc tcccgcgact cccggcgccg gcggtctggc cgtgcgcacc    240
ttcgtgtcgc acttcaggga ccgcgcggtg gccggccacc tgacgcgggc cgttgagccc    300
ctgcgcacct tctcggtgct ggagcccggt ggacccggcg gctgcgcggc gagacgacgc    360
gccaccgtgg aggagacggc gcgggcggcc gactgccgtg tcgcccagaa cggcggcttc    420
ttccgcatga actcgggcga gtgctggggg aacgtggtga gcgagagcg gcgggtgagc    480
agctccgggg ggctgcagaa cgcgcagttc gggatccgcc gcgacgggac cctggtcacc    540
gggtacctgt ctgaggagga ggtgctggac actgagaacc catttgtgca gctgctgagt    600
ggggtcgtgt ggctgattcg taatggaagc atctacatca cgagagcca agccacagag    660
tgtgacgaga cacaggagac aggttccttt agcaaatttg tgaatgtgat atcagccacg    720
acgcgccattg gccacgaccg gaaagggcag ctggtgctct ttcatgcaga cggccaaacg    780
gagcagcgtg gcatcaacct gtgggaaatg gcggagttcc tgctgaaaca ggacgtggtc    840
aacgccatca acctggatgg gggtggctct gccacctttg tgctcaacgg gaccttggcc    900
agttaccccgt cagatcactg ccaggacaac atgtggcgct gtcccgcca gtgtccacc    960
gtggtgtgtg tgcacgaacc ccgctgccag ccgcctgact gccacggcca cgggacctgc   1020
gtggacgtgg actgccaatg caccctggac ttctggctgg gtccccggctg tgatgagctg   1080
gactgtggcc cctctaactg cagccagcac ggactgtgca cggagaccgg ctgccgctgt   1140
gatgccggat ggaccgggtc caactgcagt gaagagtgtc cccttggctg gcatgggccg   1200
ggctgccaga ggccttgtaa gtgtgagcac cattgtccct gtgacccaa gactggcaac   1260
tgcagcgtct ccagagtaaa gcagtgtctc cagccacctg aagccaccct gagggcggga   1320
gaactctcct ttttccaccag gaccgcctgg ctagccctca cctgcgcgct ggccttcctc   1380
```

TABLE 2-continued

```
ctgctgatca gcactgcagc aaacctgtcc ttgctcctgt ccagagcaga gaggaaccgg    1440
cgcctgcatg gggactatgc ataccacccg ctgcaggaga tgaacgggga gcctctggcc    1500
gcagagaagg agcagccagg gggcgcccac aaccccttca aggactga                 1548
```

SEQ ID NO: 170 Human N-acetylglucosamine-1-phosphodiester alpha-N-
acetylglucosaminidase (NAGPA), amino acid sequence (NP_057340.2)

```
MATSTGRWLL LRLALFGFLW EASGGLDSGA SRDDDLLLPY PRARARLPRD CTRVRAGNRE     60
HESWPPPPAT PGAGGLAVRT FVSHFRDRAV AGHLTRAVEP LRTFSVLEPG GPGGCAARRR    120
ATVEETARAA DCRVAQNGGF FRMNSGECLG NVVSDERRVS SSGGLQNAQF GIRRDGTLVT    180
GYLSEEEVLD TENPFVQLLS GVVWLIRNGS IYINESQATE CDETQETGSF SKFVNVISAR    240
TAIGHDRKGQ LVLFHADGQT EQRGINLWEM AEFLLKQDVV NAINLDGGGS ATFVLNGTLA    300
SYPSDHCQDN MWRCPRQVST VVCVHEPRCQ PPDCHGHGTC VDGHCQCTGH FWRGPGCDEL    360
DCGPSNCSQH GLCTETGCRC DAGWTGSNCS EECPLGWHGP GCQRPCKCEH HCPCDPKTGN    420
CSVSRVKQCL QPPEATLRAG ELSFFTRTAW LALTLALAFL LLISTAANLS LLLSRAERNR    480
RLHGDYAYHP LQEMNGEPLA AEKEQPGGAH NPFKD                               515
```

SEQ ID NO: 171 Mouse N-acetylglucosamine-1-phosphodiester alpha-N-
acetylglucosaminidase (NAGPA), cDNA (NM_013796.)

```
atggcggcgc ccaggggggcc cgggctgttc ctcataccccg cgctgctcgg cttactcggg     60
gtggcgtggt gcagcctaag cttcggggtt tcccgcgacg atgacctgct gctgccttac    120
ccactagcgc gcagacgtcc ctcgcgagac tgcgcccggg tgcgctcagg tagcccagag    180
caggagagct ggcctccgcc acccacgaac cccggcgcca gccaccacgc ggccgtgcgc    240
accttcgtgt cgcacttcga ggggcgcgcg gtggccggcc acctgaccgt ggtcgccgat    300
cccctacgca cttttctcggt gctggagccc ggaggagccg ggggctgcgc gcagaagcgc    360
cgcgctactg tggaggacac agccgtcccg gccggttgcc gcatcgctca gaacggtggc    420
ttcttccgca tgagcactgg cgagtgcttg ggaacgtgg tgagcgacgg gcggctggtg    480
agcagctcag ggggactgca gaacgcgcag ttcggtatcc gacgcgatgg aaccatagtc    540
accgggtacc tgtctgagga ggaggttctg gatcccgtga atccgttcgt gcagctgctg    600
agcggagtcg tgtggctcat ccgcaatgga aacatctaca tcaacgagag ccaagccatc    660
gagtgtgacg agacacagga gacaggttct tttagcaaat tgtgtaatgt gatgtcagcc    720
aggacagccg tgggtcatga ccgtgagggg cagcttatcc tcttccatgc tgatggacag    780
acggaacagc gtggccttaa cctatggag atggcagagt tcctgcgtca acaagatgtc    840
gtcaatgcca tcaacctgga tggaggcggt tctgctactg ttgtgctcaa tgggaccctg    900
gccagttacc cttcagatca ctgccaggac aacatgtggc gctgtccccg ccaagtgtcc    960
actgtggtgt gtgtgcatga accgcgctgc cagccacccg actgcagtgg ccatgggacc   1020
tgtgtggatg gccactgtga atgcaccagc cacttctggc ggggcgaggc ctgcagcgag   1080
ctggactgtg gccccctccaa ctgcagccag catgggctgt gcacagagac tggctgccac   1140
tgtgatgctg ggtggacagg atccaactgc agtgaagagt gtcctctggg ctggtatggg   1200
ccaggttgcc agaggccctg ccagtgtgag accagtgtt cctgtgaccc gcagactggc   1260
aactgcagca tctcccaagt gaggcagtgt ctccagccaa ctgaggctac gcgagggca   1320
ggagagctgg cctcttttca caggaccacc tggctagccc tcaccctgac actaattttc   1380
ctgctgctga tcagcactgg ggtcaacgtg tccttgttcc tgggctccag ggccgagagg   1440
aaccggcacc tcgacgggga ctatgtgtat cacccactgc aggaggtgaa cggggaagcg   1500
ctgactgcag agaaggagca catggaggaa actagcaacc cctcaaggga ctga          1554
```

SEQ ID NO: 172 Mouse N-acetylglucosamine-1-phosphodiester alpha-N-
acetylglucosaminidase (NAGPA), amino acid sequence (NP_038824.2)

```
MAAPRGPGLF LIPALLGLLG VAWCSLSFGV SRDDDLLLPY PLARRRPSRD CARVRSGSPE     60
QESWPPPPTN PGASHHAAVR TFVSHFEGRA VAGHLTRVAD PLRTFSVLEP GGAGGCAQKR    120
RATVEDTAVP AGCRIAQNGG FFRMSTGECL GNVVSDGRLV SSSGGLQNAQ FGIRRDGTIV    180
TGYLSEEEVL DPVNPFVQLL SGVVWLIRNG NIYINESECE CDETQETGS FSKFVNVMSA    240
RTAVGHDREG QLILFHADGQ TEQRGLNLWE MAEFLRQQDV VNAINLDGGG SATFVLNGTL    300
ASYPSDHCQD NMWRCPRQVS TVVCVHEPRC QPPDCSGHGT CVDGHCECTS HFWRGEACSE    360
LDCGPSNCSQ HGLCTETGCH CDAGWTGSNC SEECPLGWYG PGCQRPCQCE HQCSCDPQTG    420
NCSISQVRQC LQPTEATTRA GELASFIRTT KLALTLTLIF LLLISTGVNV SLFLGSRAER    480
NRHLDGDYVY HPLQEVNGEA LTAEKEHMEE TSNPFKD                             517
```

SEQ ID NO: 173 Human protocadherin beta-15 (PCDHB15) cDNA
(NM_018935.3)

```
atggagcctg caggggagcg ctttcccgaa caaaggcaag tcctgattct ccttctttta     60
ctggaagtga ctctggcagg ctgggaaccc cgtcgctatt ctgtgatgga ggaaacagag    120
agaggttctt ttgtagccaa cctggccaat gacctagggc tgggagtggg ggagctagcc    180
gagcggggag cccgggtagt ttctgaggat aacgaacaag gcttgcagct tgatctgcag    240
accgggcagt tgatattaaa tgagaagctg gaccgggaga gctgtgtgg ccctactgag    300
ccctgtataa tgcatttcca agtgttactg aaaaaaaccct tggaagtatt tcgagctgaa    360
ctactagtga cagacataaa cgatcattct cctgagtttc tgaaagaga atgaccctg     420
aaaatcccag aaactagctc ccttgggact gtgttttcctc tgaaaaaagc tcgggacttg    480
gacgtgggca gcaataatgt tcaaaactac aatatttctc ccaattctca tttccatgtt    540
tccactcgca cccgaggga tgcaggaaaa tacccagagc tggtgctgga cacagaactg    600
gatcgcgagg agcaggccga gctcagatta accttgacag cggtggacgg tggctctcca    660
cccgctgtca gcaccgtcca gatcctcatc ttggtcttgg acgcaatga caatgcccg    720
gagtttgtgc aggcgctcta ccaggtgcag gtcccagaga acagcccagt aggctcccta    780
gttgtcaagg tctctgctag ggatttagac actgggacaa atggagagat atcatactcc    840
ctttattaca gctctcagga gatagacaaa cctttttgagc taagcagcct tcaggagaaa    900
attgactaa ttaaaaaact agattttgag acaatgtctt cgtatgatct agatatagag    960
gcatctgatg gcgggggact ttctggaaaa tgctctgtct ctgttaaggt gctggatgtt   1020
```

TABLE 2-continued

```
aacgataact tcccggaact aagtatttca tcacttacca gcccrattcc cgagaattct    1080
ccagagacag aagtggccct gtttaggatt agagaccgag actctgggga aaatggaaaa    1140
atgatttgct caattcagga tgatgttcct tttaagctaa aaccttctgt tgagaatttc    1200
tacaggctgg taacagaagg ggcgctggac agagagacca gagccgagta caacatcacc    1260
atcaccatca cagacttggg gactccaagg ctgaaaaccg agcagagcat aaccgtgctg    1320
gtgtcggacg tcaatgacaa cgcccccgcc ttcacccaaa cctcctacac cctgttcgtc    1380
cgcgagaaca cagccccgc cctgcacatc ggcagtgtca cgccacaga cagagactcg     1440
ggcaccaacg cccaggtcac ctactcgctg ctgccgcccc gggacccgca cctgcccctc    1500
acctccctgg tctccattaa cacggacaac ggccacctgt tcgctctcca gtcgctggac    1560
tacgaggccc tgcaggcttt cgagttccgc gtgggcgcca cagaccgcgg cttcccggcg    1620
ctgagcagcg aggcgctggt gcgagtgctg gtgctggacg ccaacgacaa ctcgcccttc    1680
gtgctgtacc cgctgcagaa cggctccgcg ccctgcaccg agctggtgcc ccgggcggcc    1740
gagccgggct acctggtgac caaggtggtg gcggtgggca gcgactcggg ccagaacgcc    1800
tggctgtcgt accagctgct caaggccacg gagcccgggc tgttcggcgt gtgggcgcac    1860
aatggcgagg tgcgcaccgc caggctgctg agcgagcgcg acgtggccaa gcacaggcta    1920
gtggtgctgg tcaaggacaa tggcgagcct ccgcgctcgg ccaccgccac gctgcaagtg    1980
ctcctggtgg acggcttctc tcagccctac ctgccgctcc cagaggccgc ccggcccaa    2040
gcccaggccg actcgcttac cgtctacctg gtggtggcat tggcctcggt gtcttcgctc    2100
ttcctcttct cggtgttcct gttcgtggca gtgcggctgt gcaggaggag cagggcggcc    2160
tcagtgggtc gctgctcggt gcccgaggc cccttttccag gcatctggt ggacgtgagc     2220
ggcaccggga ccctttccca gagctaccag tacgaggtgt gtctgacggg aggctctgaa    2280
agtaatgatt tcaagttctt gaagcctata ttcccaaata ttgtaagcca ggactctagg    2340
aggaaatcag aatttctaga ataa                                          2364
```

SEQ ID NO: 174 Human protocadherin beta-15 (PCDHB15), amino acid
sequence (NP_061758.1)

```
MEPAGERFPE QRQVLILLLL LEVTLAGWEP RRYSVMEETE RGSFVANLAN DLGLGVGELA     60
ERGARVVSED NEQGLQLDLQ TGQLILNEKL DREKLCGPTE PCIMHFQVLL KKPLEVFRAE    120
LLVTDINDHS PEEPEREMTL KIPETSSLGT VFPLKKARDL DVGSNNVQNY NISPNSHFHV    180
STRTRGDGRK YPELVLDTEL DREEQAELRL TLTAVDGGSP PRSGTVQILI LVLDANDNAP    240
EFVQALYEVQ VPENSPVGSL VVKVSARDLD TGTNGEISYS LYYSSQEIDK PFELSSLSGE    300
IRLIKKLDFE TMSSYDLDIE ASDGGGLSGK CSVSVKVLDV NDNFPELSIS SLTSPIPENS    360
PETEVALFRI RDRDSGENGK MICSIQDDVP FKLKPSVENF YRLVTEGALD RETRAEYNIT    420
ITITDLGTPR LKTEQSITVL VSDVNDNAPA FIQTSYTLEV RENNSPALHI GSVSATDRDS    480
GTNAQVTYSL LPPRDPHLPL ISLVSINTDN GHLFALQSLD YEALQAFEFR VGATDRGFPA    540
LSSEALVRVL VLDANDNSPF VLYPLQNGSA PCTELVPRAA EPGYLVTKVV AVDGDSGQNA    600
WLSYQLLKAT EPGLFGVWAH NGEVRTARLL SERDVAKHRL VVLVKDNGEP PRSATATLQV    660
LLVDGFSQPY LPLPEAAPAQ AQADSLTVYL VVALASVSSL FLFSVFLFVA VRLCRRSRAA    720
SVGRCSVPEG PFPGHLVDVS GTGTLSQSYQ YEVCLTGGSE SNDFKFLKPI FPNIVSQDSR    780
RKSEFLE                                                             787
```

SEQ ID NO: 175 Mouse protocadherin beta-15 (PCDHB15) cDNA
(NM_053147.3)

```
atgaagattg aagggaaca cagaaaaagg caagttctgt tgatctttct cttgctggga     60
gtggttgggg cgggctcgga accccgccgc tactttgtga tggaggaaac acccagtggc    120
actgttttgg cagatctagt ccaggaccta gggcttggag ttgcggagct agctgctcga    180
ggagcccagg tagtctctga ggaaaaggaa tcccgcttgc agctggatct acagactggg    240
aagctaatct taaatgaaaa actgaccgc gaggagctgt gcggctccaa tgagcctgt      300
gtcactcatt tccaagtgtt actgaaaaaa ccactggaaa tatttcaagc tgagctacga    360
gtaggagaca ttaatgatca ttctcctgag tttcctgaaa gagaaatggc cgtgaaaatc    420
ataggaataa gccctgttgg cactgcgttt ctactcaaaa cagctcagga tttggatgtg    480
ggaaataaca gcgttcagaa ctataagatt ggtaccaatt ctcatttcca tgtttccatc    540
cgcaaccgag gtgatggaag aaaatacccca gagctggtgc tggacaagga gctcgatcgc    600
gaggtgcagg cagcgttcag attaactctg acagcgctag atggcggttc tccgcccagg    660
actggcacct cgcaaatccg cattgttgtc ttggatgtca atgacaatgc ccctgagttt    720
gcacaggctt tctaccgggt gcaaattcca gagaacagtc cctcgggttc catggttgct    780
aaggtctctg ctaaggattt agacactggg acaaatggag aggtatcata ctctcttttt    840
cacagttctc aggaaatgag caaaacttt gagctaaacg ccctgtcagg agaagttcga    900
ctaatcaaaa cactggactt tgagacaaca ccttcatatg aactagacat agaggcaact    960
gatggcgggg gtctttctgg aaaatgctct gtttctattc aggtggtgga tgtcaacgat   1020
aattacccag aactaatttat atcatcgctc accaatccaa ttcaccagag                1080
acagaggtgg ctctgtttcg gattcgagac cgagactctg agagaatggg aaggacaatt    1140
tgttccatcc aggatggtgt tccctttaca ctggaacctt ccgttgagaa cttctataga    1200
ctggtgacag atggagctct ggacagagag atcagagctg agtacaacat tactatctcc    1260
gtcaccgacc tgggcacatc caagctcaca acccagcaca ccataacgac gcaggtgtcc    1320
gacatcaacg acaatgcccc cgcctttacc caagtctcct acaccatgct cgtccacgag    1380
aacaacagcc cagccctgca cataggcacc atcagcgcca cagactcaga tcaggctcc     1440
aatgcccaca tcacctactc gttgctgccg gcccaggagc acagctggcc cctcaactca    1500
ctcatctcca tcaacgctga caacgggcag ctgttcgccg tcagggcgct ggactacgag    1560
gccctgcagg ccttcgagtt ccacgtgagt gccacagacc gaggctcacc agcgctcagc    1620
agccaggctc tggtgcgcat agtggtgctg gacgacaatg acaatgcgcc cttcgtgctc    1680
tacccgatgc agaatgcctc tgcgcctgc acagagctgc tgccagggc ggcagagccc       1740
ggctacctgg tcaccaaggt ggtgctctgt gatcgcgaat ctggccagaa tgcctgctgg    1800
tcgttccagc tgctcaaggc tacagagccc gggttgttca gcgtgtgggc gcacaatggt    1860
gaggtgcgca ccaccaggct gttgagtgag cgagatgtac ccaagcacag gctgctgctg    1920
gtggtcaagg acaatggaga gcctccgcgc tctgctagcg tcacactgca ggtgctaatg    1980
gtggatggct tctctcagcc ctacctgcct ctgccagagg tggtgcgcga ccccagtcac    2040
caggaaggtg atgtgctcac gctgtacctg gtcatagcct tggcttctgt gtcttctctc    2100
```

TABLE 2-continued

```
ttcctcttgt ctgtgctgct gtttgtgggg gtgaggctgt gcaggagggc cagggaggtc    2160
tctctgggtg gctgctctgt gcctgaggga cactttcctg gccacctggt ggatgtcagc    2220
ggggcaggga ccctgtctca gagctaccag tatgaggtgt gtcttacagg agattctcag    2280
agtaatgagt tcaaattctt gaagcctgtg ttttctggta ttgtagacca aaactatggt    2340
aggcaaccag atgatcagtc cttctcaagt gttttaggta tgtga                   2385
```

SEQ ID NO: 176 Mouse protocadherin beta-15 (PCDHB15), amino acid
sequence (NP_444377.3)

```
MKIGREHRKR QVLLIFLLLG VVGAGSEPRR YFVMEETPSG TVLADLVQDL GLGVAELAAR     60
GAQVVSEEKE SRLQLDLQTG KLILNEKLDR EELCGSTEPC VTHFQVLLKK PLEIFQAELR    120
VGDINDHSPE FPEREMAVKI IENSPVGTAF LLKTAQDLDV GNNSVQNYKI GINSHFHVSI    180
RNRGDGRKYP ELVLDKELDR EVQAAFRLIL TALDGGSPPR TGISQIRIVV LDVNDNAPEF    240
AQAFYRVQIP ENSPSGSMVA KVSAKDLDIG INGEVSYSLF HSSQEMSKIF ELNALSGEVR    300
LIKILDFETT PSYELDIEAT DGGGLSGKCS VSIQVVDVND NYPELIISSL INPIPENSPE    360
TEVALFRIRD RDSGENGRTI CSIQDGVPFT LEPSVENFYR LVIDGALDRE IRAEYNITIS    420
VIDLGIPKLI TQHTITVQVS DINDNAPAFT QVSYTMLVHE NNSPALHIGT ISAIDSDSGS    480
NAHITYSLLP AQEPQLALNS LISINADNGQ LFALRALDYE ALQAFEFHVS ATDRGSPALS    540
SQALVRIVVL DDNDNAPFVL YPMQNASAPC TELLPRAAEP GYLVIKVVAV DRDSGQNAWL    600
SFQLLKATEP GLFSVWAHNG EVRTIRLLSE RDVPKHRLLL VVKDNGEPPR SASVILQVLM    660
VDGFSQPYLP LPEVVRDPSH QEGDVLTLYL VIALASVSSL FLLSVLLFVG VRLCRRAREV    720
SLGGCSVPEG HFPGHLVDVS GAGILSQSYQ YEVCLIGDSQ SNEFKFLKPV FSGIVDQNYG    780
RQPDDQSFSS VLGM                                                     794
```

SEQ ID NO: 177 Human uracil phosphoribosyltransferase (UPRT) cDNA,
transcript variant 1 (NM_145052.3)

```
atggccacgg agttacagtg tccgactcc atgccctgtc acaaccagca agtaaactct      60
gcctcaaccc caagtcccga gcagctgcga cctggcgatc tgatcctgga ccacgcaggg    120
ggaaacagag cctccagggc caaggtgatt ctcctcacgg gtacgcccca ttctagcctg    180
ccggccgagc tggactctgg ggcctgcggc ggctccaacc tcaactcaga gggcaacagt    240
ggtagtggtg acagtagcag ctatgacgca ccagctggca actccttcct agaggactgc    300
gaactctccc ggcagatcgg ggcgcagctt aagctgctgc ctatgaatga tcagatacgg    360
gagctacaga ccatcatccg tgacaagaca gccagtagag gtgacttcat gttttctgcg    420
gatcgtttga tcagacttgt tgtggaagag ggattgaatc agctgccata taagaatgc     480
atggtgacca ctccaacagg gtacaagtat gaaggagtga aatttgagaa gggaaattgt    540
ggggtcagca taatgagaag cggtgaggca atggaacaag gttacgaga ctgctgtcga     600
tccatacgaa ttggaaaagat cctgattcag agtgatgagg agacacaaag agccaaagta    660
tattatgcca aattccccc agacatttac cggagaaaag tccttctgat gtatccaatt      720
ctcagcactg gaaatactgt aattgaagct gtaaaggttc ttatagaaca tggagttcaa    780
cccagtgtta tcatcctact cagtctgttc tccactcctc atggtgccaa atcaatcatt    840
caggagtttc cagagatcac aattttaact actgaagttc atcctgttgc acctacacat    900
tttgacagaa aatactttgg aacagactaa                                     930
```

SEQ ID NO: 178 Human uracil phosphoribosyltransferase (UPRT) cDNA,
transcript variant 3 (NM_001307944.1)

```
atggccacgg agttacagtg tccgactcc atgccctgtc acaaccagca agtaaactct      60
gcctcaaccc caagtcccga gcagctgcga cctggcgatc tgatcctgga ccacgcaggg    120
ggaaacagag cctccagggc caaggtgatt ctcctcacgg gtacgcccca ttctagcctg    180
ccggccgagc tggactctgg ggcctgcggc ggctccaacc tcaactcaga gggcaacagt    240
ggtagtggtg acagtagcag ctatgacgca ccagctggca actccttcct agaggactgc    300
gaactctccc ggcagatcgg ggcgcagctt aagctgctgc ctatgaatga tcagatacgg    360
gagctacaga ccatcatccg tgacaagaca gccagtagag gtgacttcat gttttctgcg    420
gatcgtttga tcagacttgt tgtggaagag ggattgaatc agctgccata taagaatgc     480
atggtgacca ctccaacagg gtacaagtat gaaggagtga aatttgagaa gggaaattgt    540
ggggtcagca taatgagaag cggtgaggca atggaacaag gttacgaga ctgctgtcga     600
tccatacgaa ttggaaaagat cctgattcag agtgatgagg agacacaaag agccaaagta    660
tattatgcca aattccccc agacatttac cggagaaaag tccttctgat gtatccaatt      720
ctcagcactg gaaatactgt aattgaagct gtaaaggttc ttatagaaca tggagttcaa    780
cccagtgtta tcatcctact cagtctgttc tccactcctc atggtgagtt cagcatgagg    840
cagtaa                                                               846
```

SEQ ID NO: 179 Human uracil phosphoribosyltransferase (UPRT) amino
acid sequence, isoform 1 (NP_659489.1)

```
MATELQCPDS MPCHNQQVNS ASTPSPEQLR PGDLILDHAG GNRASRAKVI LLIGYAHSSL     60
PAELDSGACG GSSLNSEGNS GSGDSSSYDA PAGNSFLEDC ELSRQIGAQL KLLPMNDQIR    120
ELQIIIRDKI ASRGDFMFSA DRLIRLVVEE GLNQLPYKEC MVITPTGYKY EGVKFEKGNC    180
GVSIMRSGEA MEQGLRDCCR SIRIGKILIQ SDEETQRAKV YYAKFPPDIY RRKVLLMYPI    240
LSIGNIVIEA VKVLIEHGVQ PSVIILLSLF STPHGAKSII QEFPEITILT TEVHPVAPTH    300
FGQKYEGID                                                            309
```

TABLE 2-continued

SEQ ID NO: 180 Human uracil phosphoribosyltransferase (UPRT) amino
acid sequence, isoform 2 (NP_001294873.1)

```
MATELQCPDS MPCHNQQVNS ASTPSPEQLR PGDLILDHAG GNRASRAKVI LLIGYAHSSL    60
PAELDSGACG GSSLNSEGNS GSGDSSSYDA PAGNSFLEDC ELSRQIGAQL KLLPMNDQIR   120
ELQIIIRDKI ASRGDFMFSA DRLIRLVVEE GLNQLPYKEC MVITPTGYKY EGVKFEKGNC   180
GVSIMRSGEA MEQGLRDCCR SIRIGKILIQ SDEETQRAKV YYAKFPPDIY RRKVLLMYPI   240
LSIGNIVIEA VKVLIEHGVQ PSVIILLSLF STPHGEFSMR Q                       281
```

SEQ ID NO: 181 Mouse uracil phosphoribosyltransferase (UPRT) cDNA
(NM_001081189.1)

```
atggcctcgg agttacagcg tccggactcc atgccctgtc acaatcggca agtaaactct    60
acttctagcc caagtcccga gcatctgcta gccgaggacc gggtcctgga tcatgcagag   120
gaaaataacg ctgctatggc taagctgact ctcctccctg gcacgccca ttctagcgtg    180
ctttcggagc gggactctcc ggcctgctgc agcactaact ttcactctga gaaccacagt   240
gacagtagtg acagtggcaa ctacgatgca cctgtcggcg gcgactccct gctaggggac   300
tgtgaactct cccgacagat tggggctcag cttaagttgc tgcctatgaa tgatcagatc   360
cgggagcttc agactatcat ccgggacaag acagccagta gaggggactt catgttttct   420
gcagatcgct tgatcagact tgtttgtaga gagggactga atcagctgcc atataaagaa   480
tgtatggtga ccactccgac agggcacaag tatgaaggag tgaaatttga gaaggaaat   540
tgtggggtca gcataatgag aagtggtgag gcaatgaac aaggtttgcg agactgctgt    600
cgatccatac ggattgggaa gatcctgatt cagagtgatg aggagacaca aagggccaaa   660
gtatattatg ccaagttccc cccagacatt catcgcacaga aagtccttct gatgtatcca   720
attctcagta ctggaaatac tgtaattgaa gctgtaaagg ttcttataga acatggtgtt   780
caacccagtg ttattatcct actcagtctc ttctccaccc cacatggtgc caaatcaatc   840
attcaagaat ttccagagat cacaatttta actacagaag tccatcctgt tgcacctaca   900
cattttggac agaaatactt tggaacagac taa                                933
```

SEQ ID NO: 182 Mouse uracil phosphoribosyltransferase (UPRT) amino
acid sequence (NP_001074658.1)

```
MASELQRPDS MPCHNRQVNS ISSPSPEHLL AEDRVLDHAE ENNAAMAKLI LLPGHAHSSV    60
LSERDSPACC SINLHSENHS DSSDSGNYDA PVGGDSLLGD CELSRQIGAQ LKLLPMNDQI   120
RELQIIIRDK TASRGDFMES ADRLIRLVVE EGLNQLPYKE CMVITTIGHK YEGVKFEKGN   180
CGVSIMRSGE AMEQGLRDCC RSIRIGKILI QSDEETQRAK VYYAKFPPDI HRRKVLLMYP   240
ILSIGNIVIE AVKVLIEHGV QPSVIILLSL FSTPHGAKSI IQEFPEITIL TTEVHPVAPT   300
HFGQKYEGID                                                         310
```

SEQ ID NO: 183 Human Glutamate Ionotropic Receptor NMDA Type
Subunit 1 (GRIN1) cDNA, transcript variant 1a (NM_007327.3)

```
atgagcacca tgcgcctgct gacgctcgcc ctgctgttct cctgctccgt cgccgtgcc     60
gcgtgcgacc ccaagatcgt caacattggc gcggtgctga gcacgcggaa gcacgagcag   120
atgttccgcg aggccgtgaa ccaggccaac aagcggcacg gtcctggaa gattcagctc    180
aatgccacct ccgtcacgca caagcccaac gccatccaga tggctctgtc ggtgtgcgag   240
gacctcatct ccagccaggt ctacgccatc ctagttagcc atccacctac ccccaacgac   300
cacttcactc ccaccctgt ctcctacaca gccggcttct accgcatacc cgtgctgggg    360
ctgaccaccc gcatgtccat ctactcggac aagagcatcc acctgagctt cctgcgcacc   420
gtgccgccct actcccacca gtccagcgtg tggtttgaga tgatgcgtgt ctacagctgg   480
aaccacatca tcctgctggt cagcgacgac acgagggcc gggcggctca gaaacgcctg   540
gagacgctgc tggaggagcg tgagtccaag gcagagaagg tgctgcagtt tgacccaggg   600
accaagaacg tgacggcct gctgctggag gcgaaagagc tggaggcccg ggtcatcatc   660
ctttctgcca gcgaggacga tgctgccact gtataccgcg cagccgcgt gctgaacatg   720
acgggctccg ggtacgtgtg gctggtcggc gagcgcgaga tctcggggaa cgccctgcgc   780
tacgccccag acggcatcct cgggctgcag ctcatcaacg gcaagaacga gtcggcccac   840
atcagcgacg ccgtgggcgt ggtgggccag gccgtgcacg agctcctcga aggagaac    900
atcaccgacc cgccgcggg ctgcgtgggc aacaccaaca tctggaagac cgggccgctc   960
ttcaagagag tgctgatgtc ttccaagtat gcggatgggg tgactggtcg cgtggagttc   1020
aatgaggatg ggaccggaa gttcgccaac tacagcatca tgaacctgca gaaccgcaag  1080
ctggtgcaag tgggcatcta caatggcacc cacgtcatcc ctaatgacag aagatcatc   1140
tggccaggcg gagagacaga gaagcctcga gggtaccaga tgtccaccag atcgaagatt   1200
gtgacgatcc accaggagcc cttcgtgtac gtcaagccca gctgagtga tgggacatgc   1260
aaggaggagt tcacagtcaa cggcgaccca gtcaagaagg tgatctgcac cgggcccaac   1320
gacacgtcgc cgggcagccc ccgccacacg gtgcctcagt gttgctacgg cttttgcatc   1380
gacctgctca tcaagctggc acggaccatg aacttccact acgaggtgca cctggtggca   1440
gatggcaagt tcggcacaca ggagcgggtg aacaacaca acaagaagga gtggaatggg   1500
atgatgggcg agctgctcag cggcaggca gacatgatcg tggcgccgct aaccataaac   1560
aacgagcgcg cgcagtacat cgagtttttc aagcccttca gtaccaggg cctgactatt   1620
ctggtcaaga aggagattcc ccggagcacg ctgaactcc tcatgcagcc gttccagatg   1680
acactgtggc tgctggtggg gctgtccgtg cacgtggtgg ccgtgatgct gtacctgctg   1740
gaccgcttca gccccttcgg ccggttcaag gtgaacagcg aggaggagga ggaggacgca   1800
ctgaccctgt cctcggccat gtggttctcc tgggcgtcc tgctcaactc cggcatcggg   1860
gaaggcgccc ccagaagctt ctcagcgcgc atcctgggca tggtgtggc cggctttgtg   1920
atgatcatcg tggcctccta caccgccaac ctgccggcct tcctgtgct ggaccggccg   1980
gaggagcgca tcacgggcat caacgaccct cggccgagga ccccgcgga caagtttatc   2040
tacgccacgg tgaagcagag ctcgtggat atctactcc ggcgcaggt ggagctgagc    2100
accatgtacc ggcatatgga gaagcacaac tacgagagtg cggcggaggc catccaggcc   2160
gtgagagaca caaagctgca tgccttcatc tgggactcgg cggtgctgga gttcgaggcc   2220
```

TABLE 2-continued

```
tcgcagaagt gcgacctggt gacgactgga gagctgtttt tccgctcggg cttcggcata    2280
ggcatgcgca aagacagccc ctggaagcag aacgtctccc tgtccatcct caagtcccac    2340
gagaatggct tcatggaaga cctggacaag acgtgggttc ggtatcagga atgtgactcg    2400
cgcagcaacg cccctgcgac ccttactttt gagaacatgg ccggggtctt catgctggta    2460
gctggggca tcgtggccgg gatcttcctg attttcatcg agattgccta caagcggcac    2520
aaggatgctc gccggaagca gatgcagctg gcctttgccg ccgttaacgt gtggcggaag    2580
aacctgcagg atagaaagag tggtagagca gagcctgacc ctaaaaagaa agccacattt    2640
agggctatca cctccaccct ggcttccagc ttcaagaggc gtaggtcctc caaagacacg    2700
agcaccgggg gtggacgcgg cgctttgcaa aaccaaaaag acacagtgct gccgcgacgc    2760
gctattgaga gggaggaggg ccagctgcag ctgtgttccc gtcatagga gagctga       2817
```

SEQ ID NO: 184 Human Glutamate Ionotropic Receptor NMDA Type
Subunit 1 (GRIN1) cDNA, transcript variant 2a (NM_021569.3)

```
atgagcacca tgcgcctgct gacgctcgcc ctgctgttct cctgctccgt cgcccgtgcc      60
gcgtgcgacc ccaagatcgt caacattggc gcggtgctga gcacgcggaa gcacgagcag    120
atgttccgcg aggccgtgaa ccaggccaac aagcggcacg gctcctggaa gattcagctc    180
aatgccacct ccgtcacgca caagcccaac gccatccaga tggctctgtc ggtgtgcgag    240
gacctcatct ccagccaggt ctacgccatc ctagttagcc atccacctac ccccaacgac    300
cacttcactc ccaccctgt ctcctacaca gccggcttct accgcatacc cgtgctgggg    360
ctgaccaccc gcatgtccat ctactcggac aagagcatcc acctgagctt cctgcgcacc    420
gtgccgccct actcccacca gtccagcgtg tggtttgaga tgatgcgtgt ctacagctgg    480
aaccacatca tcctgctggt cagcgacgac acgagggcc gggcggctca gaaacgcctg    540
gagacgctgc tggaggagcg tgagtccaag gcagagaagg tgctgcagtt tgacccaggg    600
accaagaacg tgacggcccc gctgatggag gcgaaagagc tggaggcccg ggtcatcatc    660
ctttctgcca gcgaggacga tgctgccact gtataccgcg cagccgcgat gctgaacatg    720
acgggctccg ggtacgtgtg gctggtcggc gagcgcgaga tctcggggaa cgccctgcgc    780
tacgcccag acggcatcct cggggctcag ctcatcaacg gcaagaacga gtcggcccac    840
atcagcgacg ccgtgggcgt ggtggcccag gccgtgcacg agctcctcga gaaggagaac    900
atcaccgacc cgccgcgggc ctgcgtgggc aacaccaaca tctggaagac cgggccgctc    960
ttcaagagag tgctgatgtc ttccaagtat gcggatgggg tgactggtcg cgtggagttc    1020
aatgaggatg ggaccggaa gttcgccaac tacagcatca tgaacctgca gaaccgcaag    1080
ctggtgcaag tgggcatcta caatggcacc cacgtcatcc ctaatgacag gaagatcatc    1140
tggccggcg gagagacaga gaagcctcga gggtaccaga tgtccaccag actgaagatt    1200
gtgacgatcc accaggagcc cttcgtgtac gtcaagccca cgctgagtga tgggacatgc    1260
aaggaggagt tcacagtcaa cggcgaccca gtcaagaagg tgatctgcac cgggcccaac    1320
gacacgtcgc cgggcagccc ccgccacacg gtgcctcagt gttgctacgg cttttgcatc    1380
gacctgctca tcaagctggc acggaccatg aacttcacct acgaggtgca cctggtggca    1440
gatggcaagt tcggcacaca ggagcgggtg aacaacagca caagaagga gtggaatggg    1500
atgatgggcg agctgctcag cgggcaggca gacatgatcg tggcgccgct aaccataaac    1560
aacgagcgcg cgcagtacat cgagttttcc aagcccttca gtaccagg cctgactatt    1620
ctggtcaaga aggagattcc ccggagcacg ctggactgct atcagcc tcatccagag    1680
acactgtggc tgctggtggg gctgcgtgg cacgtggtgg ccgtgatgct gtacctgctg    1740
gaccgcttca gccccttcgg ccggttcaag gtgaacagcg aggaggagga ggaggacgca    1800
ctgacccgt cctcggccat gtggttctcc tggggcgtcc tgctcaactc cggcatcggg    1860
gaaggcgccc ccagaagctt ctcagcgcgc atcctgagca tggtgtggc cggctttgcc    1920
atgatcatcg tggcctccta caccgccaac ctgcgcgcct tcctggtgct ggaccggccg    1980
gaggagcgca tcacgggcat caacgaccct cggctgagga cccccgga caagtttatc    2040
tacgccacgg tgaagcagag ctccgtggat atctacttcc ggcgccaggt ggagctgagc    2100
accatgtacc ggcatatgga aagcacaac tacgagagtg cggcggagc catccaggcc    2160
gtgagagaca acaagctgca tgccttcatc tgggactcgg cggtgctgga gttcgaggcc    2220
tcgcagaagt gcgacctggt gacgactgga gagctgtttt tccgctcggg cttcggcata    2280
ggcatgcgca aagacagccc ctggaagcag aacgtctccc tgtccatcct caagtcccac    2340
gagaatggct tcatggaaga cctggacaag acgtgggttc ggtatcagga atgtgactcg    2400
cgcagcaacg cccctgcgac ccttactttt gagaacatgg ccggggtctt catgctggta    2460
gctggggca tcgtggccgg gatcttcctg attttcatcg agattgccta caagcggcac    2520
aaggatgctc gccggaagca gatgcagctg gcctttgccg ccgttaacgt gtggcggaag    2580
aacctgcaga gcaccggggg tggacgcggc gctttgcaaa ccaaaaaga cacagtgctg    2640
ccgcgacgcg ctattgagag ggaggaggc cagctgcagc tgtgttcccg tcatagggag    2700
agctga                                                                2706
```

SEQ ID NO: 185 Human Glutamate Ionotropic Receptor NMDA Type
Subunit 1 (GRIN1) cDNA, transcript variant 3b (NM_001185090.1)

```
atgagcacca tgcgcctgct gacgctcgcc ctgctgttct cctgctccgt cgcccgtgcc      60
gcgtgcgacc ccaagatcgt caacattggc gcggtgctga gcacgcggaa gcacgagcag    120
atgttccgcg aggccgtgaa ccaggccaac aagcggcacg gctcctggaa gattcagctc    180
aatgccacct ccgtcacgca caagcccaac gccatccaga tggctctgtc ggtgtgcgag    240
gacctcatct ccagccaggt ctacgccatc ctagttagcc atccacctac ccccaacgac    300
cacttcactc ccaccctgt ctcctacaca gccggcttct accgcatacc cgtgctgggg    360
ctgaccaccc gcatgtccat ctactcggac aagagcatcc acctgagctt cctgcgcacc    420
gtgccgccct actcccacca gtccagcgtg tggtttgaga tgatgcgtgt ctacagctgg    480
aaccacatca tcctgctggt cagcgacgac acgagggcc gggcggctca gaaacgcctg    540
gagacgctgc tggaggagcg tgagtccaag agtaaaaaaa ggaactatga aaacctcgac    600
caactgtcct atgacaacaa gcgcggaccc aaggcagaga aggtgctgca gtttgaccca    660
gggaccaaga acgtgacggc cctgctgatg gaggcgaaag agctggaggc ccgggtcatc    720
atcctttctg ccagcgagga cgatgctgcc actgtataccg cgcagccgc gatgctgaac    780
atgacgggct ccgggtacgt gtggctggtc ggcgagcgcg agatctcggg gaacgccctg    840
cgctacgccc cagacggcat cctcggctg cagctcatca cggcaagaa cgagtcggcc    900
cacatcagcg acgccgtggg cgtggtggcc caggccgtgc acgagctcct cgagaaggag    960
```

TABLE 2-continued

| | | | | | |
|---|---|---|---|---|---|
| aacatcaccg | acccgccgcg | gggctgcgtg | ggcaacacca | acatctggaa | gaccgggccg | 1020 |
| ctcttcaaga | gagtgctgat | gtcttccaag | tatgcggatg | gggtgactgg | tcgcgtggag | 1080 |
| ttcaatgagg | atggggaccg | gaagttcgcc | aactacagca | tcatgaacct | gcagaaccgc | 1140 |
| aagctggtgc | aagtgggcat | ctacaatggc | acccacgtca | tccctaatga | caggaagatc | 1200 |
| atctggccag | gcggagagac | agagaagcct | cgagggtacc | agatgtccac | cagactgaag | 1260 |
| attgtgacga | tccaccagga | gcccttcgtg | tacgtcaagc | ccacgctgag | tgatgggaca | 1320 |
| tgcaaggagg | agttcacagt | caacggcgac | ccagtcaaga | aggtgatctg | caccgggccc | 1380 |
| aacgacacgt | cgccgggcag | cccccgccac | acggtgcctc | agtgttgcta | cggcttttgc | 1440 |
| atcgacctgc | tcatcaagct | ggcacggacc | atgaacttca | cctacgaggt | gcacctggtg | 1500 |
| gcagatggca | agttcggcac | acaggagcgg | gtgaacaaca | gcaacaagaa | ggagtggaat | 1560 |
| gggatgatgg | gcgagctgct | cagcgggcag | gcagacatga | tcgtggcgcc | gctaaccata | 1620 |
| aacaacgagc | gcgcgcagta | catcgagttt | tccaagccct | tcaagtacca | gggcctgact | 1680 |
| attctggtca | agaaggagat | tccccggagc | acgctggact | cgttcatgca | gccgttccag | 1740 |
| agcacactgt | ggctgctggt | ggggctgtcg | gtgcacgtgg | tggccgtgat | gctgtacctg | 1800 |
| ctggaccgct | tcagcccctt | cggccggttc | aaggtgaaca | gcgaggagga | ggaggaggac | 1860 |
| gcactgaccc | tgtcctcggc | catgtggttc | tcctggggcg | tcctgctcaa | ctccggcatc | 1920 |
| ggggaaggcg | cccccagaag | cttctcagcg | cgcatcctgg | gcatggtgtg | ggccggcttt | 1980 |
| gccatgatca | tcgtggcctc | ctacaccgcc | aacctggcgg | ccttcctggt | gctggaccgg | 2040 |
| ccggaggagc | gcatcacggg | catcaacgac | cctcggctga | ggaacccctc | ggacaagttt | 2100 |
| atctacgcca | cggtgaagca | gagctccgtg | gatatctact | tccggcgcca | ggtggagctg | 2160 |
| agcaccatgt | accggcatat | ggagaagcac | aactacgaga | gtgccgcgga | ggccatccag | 2220 |
| gccgtgagag | acaacaagct | gcatgccttc | atctggdact | cggcggtgct | ggagttcgag | 2280 |
| gcctcgcaga | agtgcgacct | ggtgacgact | ggagagctgt | ttttccgctc | gggcttcggc | 2340 |
| ataggcatgc | gcaaagacag | cccctggaag | cagaacgtct | ccctgtccat | cctcaagtcc | 2400 |
| cacgagaatg | gcttcatgga | agacctggac | aagacgtggg | ttcggtatca | ggaatgtgac | 2460 |
| tcgcgcagca | acgccctgc | gacccttact | tttgagaaca | tggccggggt | cttcatgctg | 2520 |
| gtagctgggg | gcatcgtggc | cgggatcttc | ctgattttca | tcgagattgc | ctacaagcgg | 2580 |
| cacaaggatg | ctcgccggaa | gcagatgcag | ctggcctttg | ccgccgttaa | cgtgtggcgg | 2640 |
| aagaacctgc | aggatagaaa | gagtggtaga | gcagagcctg | accctaaaaa | gaaagccaca | 2700 |
| tttagggcta | tcacctccac | cctggcttcc | agcttcaaga | ggcgtaggtc | ctccaaagac | 2760 |
| acgcagtacc | atcccactga | tatcacgggc | ccgctcaacc | tctcagatcc | ctcggtcagc | 2820 |
| accgtggtgt | ga | | | | | 2832 |

SEQ ID NO: 186 Human Glutamate Ionotropic Receptor NMDA Type
Subunit 1 (GRIN1) cDNA, transcript variant 4a (NM_000832.6)

| | | | | | |
|---|---|---|---|---|---|
| atgagcacca | tgcgcctgct | gacgctcgcc | ctgctgttct | cctgctccgt | cgcccgtgcc | 60 |
| gcgtgcgacc | ccaagatcgt | caacattggc | gcggtgctga | gcacgcggaa | gcacgagcag | 120 |
| atgttccgcg | aggccgtgaa | ccaggccaac | aagcggcacg | gctcctggaa | gattcagctc | 180 |
| aatgccacct | ccgtcacgca | caagcccaac | gccatccaga | tggctctgtc | ggtgtgcgag | 240 |
| gacctcatct | ccagccaggt | ctacgccatc | ctagttagcc | atcccctac | ccccaacgac | 300 |
| cacttcactc | ccaccccgt | ctcctacaca | gccggcttct | accgcatacc | cgtgctgggg | 360 |
| ctgaccaccc | gcatgtccat | ctactcggac | aagagcatcc | acctgagctt | cctgcgcacc | 420 |
| gtgccgccct | actcccacca | gtccagcgtg | tggtttgaga | tgatgcgtgt | ctacagctgg | 480 |
| aaccacatca | tcctgctggt | cagcgacgac | cacgagggcc | gggcggctca | gaaacgcctg | 540 |
| gagacgctgc | tggaggagcg | tgagtccaag | gcagagaagg | tgctgcagtt | tgacccaggg | 600 |
| accaagaacg | tgacgccct | gctgatggag | gcgaaagagc | tggaggcccg | ggtcatcatc | 660 |
| ctttctgcca | gcgaggacga | tgctgccact | gtataccgcg | cagccgcgat | gctgaacatg | 720 |
| acgggctccg | ggtacgtgtg | gctggtcggc | gagcgcgaga | tctcggggaa | cgccctgcgc | 780 |
| tacgccccag | acggcatcct | cgggctgcag | ctcatcaacg | gcaagaacga | gtcggcccac | 840 |
| atcagcgacg | ccgtgggcgt | ggtgacccag | gccgtgcacg | agctcctcga | gaaggagaac | 900 |
| atcaccgacc | cgccgcggg | ctgcgtgggc | aacaccaaca | tctggaagac | cgggccgctc | 960 |
| ttcaagagag | tgctgatgtc | ttccaagtat | gcggatgggg | tgactggtcg | cgtggagttc | 1020 |
| aatgaggatg | ggaccggaa | gttcgccaac | tacagcatca | tgaacctgca | gaaccgcaag | 1080 |
| ctggtgcaag | tgggcatcta | caatggcacc | cacgtcatcc | ctaatgacag | gaagatcatc | 1140 |
| tggccggcg | gagagacaga | gaagcctcga | gggtaccaga | tgtccaccag | actgaagatt | 1200 |
| gtgacgatcc | accaggagcc | cttcgtgtac | gtcaagccca | cgctgagtga | tgggacatgc | 1260 |
| aaggaggagt | tcacagtcaa | cggcgaccca | gtcaagaagg | tgatctgcac | cgggcccaac | 1320 |
| gacacgtcgc | cgggcagccc | cgccacacg | tgcctcagt | gttgctacgg | cttttgcatc | 1380 |
| gacctgctca | tcaagctggc | acggaccatg | aacttcacct | acgaggtgca | cctggtggca | 1440 |
| gatggcaagt | tcggcacaca | ggagcgggtg | aacaacagca | acaagaaggt | ggaatggga | 1500 |
| atgatgggca | gctgctcag | cgggcaggca | gacatgatcg | tggcgcctct | aaccataaac | 1560 |
| aacgagcgcg | cgcagtacat | cgagttttcc | aagcccttca | agtaccaggg | cctgactatt | 1620 |
| ctggtcaaga | aggagattcc | ccggagcacg | ctggactcgt | tcatgcagcc | gttccagagc | 1680 |
| acactgtggc | tgctggtggg | ctgtcggtg | cacgtggtgg | ccgtgatgct | gtacctgctg | 1740 |
| gaccgcttca | gccccttcgg | ccggttcaag | gtgaacagcg | aggaggagga | ggaggacgca | 1800 |
| ctgaccctgt | cctcggccat | gtggttctcc | tggggcgtcc | tgctcaactc | cggcatcggg | 1860 |
| gaaggcgccc | ccagaagctt | ctcagcgcgc | atcctgggca | tggtgtgggc | cggctttgcc | 1920 |
| atgatcatcg | tggcctccta | caccgccaac | ctggcgcct | tcctggtgct | ggaccggccg | 1980 |
| gaggagcgca | tcacgggcat | caacgaccct | cggctgagga | acccctcgga | caagtttatc | 2040 |
| tacgccacgg | tgaagcagag | ctccgtggat | atctacttcc | ggcgccaggt | ggagctgagc | 2100 |
| accatgtacc | ggcatatgga | agcacaac | tacgagagtg | ccgcggaggc | catccaggcc | 2160 |
| gtgagagaca | acaagctgca | tgccttcatc | tgggactcgg | cggtgctgga | gttcgaggcc | 2220 |
| tcgcagaagt | gcgacctggt | gacgactgga | gagctgtttt | tccgctcggg | cttcggcata | 2280 |
| ggcatgcgca | agacagccc | tggaagcag | aacgtctccc | tgtccatcct | caagtcccac | 2340 |
| gagaatggct | tcatgaaga | cctggacaag | acgtgggttc | ggtatcagga | atgtgactcg | 2400 |
| cgcagcaacg | cccctgcgac | ccttactttt | gagaacatgg | ccggggtctt | catgctggta | 2460 |

TABLE 2-continued

```
gctgggggca tcgtggccgg gatcttcctg attttcatcg agattgccta caagcggcac    2520
aaggatgctc gccggaagca gatgcagctg gcctttgccg ccgttaacgt gtggcggaag    2580
aacctgcagc agtaccatcc cactgatatc acgggcccgc tcaacctctc agatccctcg    2640
gtcagcaccg tggtgtga                                                  2658
```

SEQ ID NO: 187 Human Glutamate Ionotropic Receptor NMDA Type
       Subunit 1 (GRIN1) cDNA, transcript variant 5b (NM_001185091.1)

```
atgagcacca tgcgcctgct gacgctcgcc ctgctgttct cctgctccgt cgcccgtgcc      60
gcgtgcgacc ccaagatcgt caacattggc gcggtgctga gcacgcggaa gcacgagcag     120
atgttccgcg aggccgtgaa ccaggccaac aagcggcacg gctcctggaa gattcagctc     180
aatgccacct ccgtcacgca caagcccaac gccatccaga tggctctgtc ggtgtgcgag     240
gacctcatct ccagccaggt ctacgccatc ctagttagcc atccacctac ccccaacgac     300
cacttcactc ccaccctgt ctcctacaca gccggcttct accgcatacc cgtgctgggg     360
ctgaccaccc gcatgtccat ctactcggac aagagcatcc acctgagctt cctgcgcacc     420
gtgccgcct actcccacca gtccagcgtg tggtttgaga tgatgcgtgt ctacagctgg     480
aaccacatca tcctgctggt cagcgacgac acgagggcc gggcggctca gaaacgcctg     540
gagacgctgc tggaggagcg tgagtccaag agtaaaaaaa ggaactatga aaacctcgac     600
caactgtcct atgacaacaa gcgcggaccc aaggcagaga aggtgctgca gtttgaccca     660
gggaccaaga acgtgacggc cctgctgatg aggcgaaag agctggaggc ccgggtcatc     720
atcctttctg ccagcgagga cgatgctgcc actgtatacc gcgcagccgc gatgctgaac     780
atgacgggct ccgggtacgt gtggctggtc ggcgagcgcg agatctcggg gaacgccctg     840
cgctacgccc cagacggcat cctcgggctg cagctcatca acggcaagaa cgagtcggcc     900
cacatcagcg acgccgtggg cgtggtgcc caggccgtgc acgagctcct cgagaaggag     960
aacatcaccg acccgccgcg gggctgcgtg ggcaacacca acatctggaa gaccgggccg    1020
ctcttcaaga gagtgctgat gtcttccaag tatgcggatg gggtgactgg tcgcgtggag    1080
ttcaatgagg atggggaccg gaagttcgcc aactacagca tcatgaacct gcagaaccgc    1140
aagctggtgc aagtgggcat ctacaatggc acccacgtca tccctaatga caggaagatc    1200
atctggccag gcggagagac agagaagcct cgagggtacc agatgtccac cagactgaag    1260
attgtgacga tccaccagga gcccttcgtg tacgtcaagc ccacgctgag tgatgggaca    1320
tgcaaggagg agttcacagt caacggcgac ccagtcaaga aggtgatctg caccgggccc    1380
aacgacacgt cgccgggcag ccccgccac acggtgcctc agtgttgcta cggcttttgc    1440
atcgacctgc tcatcaagct ggcacggacc atgaacttca cctacgaggt gcacctggtg    1500
gcagatggca agttcggcac acaggagcgg gtgaacaaca acaagaa ggagtggaat    1560
gggatgatgg gcgagctgct cagcgggcag cagacatga tcgtggcgcc gctaaccata    1620
aacaacgagc gcgcgcagta catcgagttt ccaagccct tcaagtacca gggcctgact    1680
attctggtca gaaggagat tccccggagc acgctggact cgttcatgca gccgttccag    1740
agcacactgt ggctgctggt ggggctgtcg gtgcacgtgg tggccgtgat gctgtacctg    1800
ctggaccgct tcagccccttt cggccggttc aaggtgaaca gcgaggagga ggaggaggac    1860
gcactgaccc tgtcctcggc catgtggttc tcctggggcg tcctgctcaa ctccggcatc    1920
ggggaaggcg cccccagaag cttctcagcg cgcatcctgg gcatggtgtg ggccggcttt    1980
gccatgatca tcgtggcctc ctacaccgcc aacctggcgg ccttcctggt cgtggaccgg    2040
ccggaggagc gcatcacggg catcaacgac cctcggctga ggaaccctc ggacaagttt    2100
atctacgcca cggtgaagca gagctccgtg gatatctact tccggcgcca ggtggagctg    2160
agcaccatgt accggcatat ggagaagcac aactacgaga gtgcggcgga ggccatccag    2220
gccgtgagag acaacaagct gcatgccttc atctgggaca cggcggtgct ggagttcgag    2280
gcctcgcaga agtgcgacct ggtgacgact ggagagctgt ttttccgctc gggcttcggc    2340
ataggcatgc gcaaagacag cccctggaag cagaacgtct ccctgtccat cctcaagtcc    2400
cacgagaatg gcttcatgga agacctggac aagacgtggg ttcggtatca ggaatgtgac    2460
tcgcgcagca acgccctgc gacccttact tttgagaaca tggccggggt cttcatgctg    2520
gtagctgggg gcatcgtggc cgggatcttc ctgattttca tcgagattgc ctacaagctg    2580
cacaaggatg ctcgccggaa gcagatgcag ctggcctttg ccgccgttaa cgtgtggcgg    2640
aagaacctgc agcagtacca tcccactgat atcacgggcc cgctcaacct ctcagatccc    2700
tcggtcagca ccgtggtgtg a                                              2721
```

SEQ ID NO: 188 Human Glutamate Ionotropic Receptor NMDA Type
       Subunit 1 (GRIN1) amino acid, isoform GluN1-1a (NP_015566.1)

```
MSTMRLLTLA LLFSCSVARA ACDPKIVNIG AVLSTRKHEQ MFREAVNQAN KRHGSWKIQL      60
NATSVIHKPN AIQMALSVCE DLISSQVYAI LVSHPPIPND HFIPTPVSYT AGFYRIPVLG     120
LTIRMSIYSD KSIHLSFLRT VPPYSHQSSV WFEMMRVYSW NHIILLVSDD HEGRAAQKRL     180
EILLEERESK AEKVLQFDPG TKNVIALLME AKELEARVII LSASEDDAAT VYRAAAMLNM     240
IGSGYVWLVG EREISGNALR YAPDGILGLQ LINGKNESAH ISDAVGVVAQ AVHELLEKEN     300
ITDPPRGCVG NINIWKIGPL FKRVLMSSKY ADGVIGRVEF NEDGDRKFAN YSIMNLQNRK     360
LVQVGIYNGT HVIPNDRKII WPGGETEKPR GYQMSTRLKI VIIHQEPFVY VKPILSDGIC     420
KEEFTVNGDP VKKVICTGPN DISPGSPRHT VPQCCYGFCI DLLIKLARTM NFTYEVHLVA     480
DGKEGIQERV NNSNKKEWNG MMGELLSGQA DMIVAPLTIN NERAQYIEFS KPFKYQGLII     540
LVKKEIPRST LDSFMQPFQS ILWLLVGLSV HVVAVMLYLL DRFSPFGRFK VNSEEEEEDA     600
LILSSAMWFS WGVLLNSGIG EAPRSFSAR ILGMVWAGFA MIIVASYTAN LAAFLVLDRP     660
EERITGINDP RLRNPSDKFI YATVKQSSVD IYFRRQVELS IMYRHMEKHN YESAAEAIQA     720
VRDNKLHAFI WDSAVLEFEA SQKCDLVTIG ELFFRSGFGI GMRKDSPWKQ NVSLSILKSH     780
ENGFMEDLDK TWVRYQECDS RSNAPATLIF ENMAGVFMLV AGGIVAGIFL IFIEIAYKRH     840
KDARRKQMQL AFAAVNVWRK NLQDRKSGRA EPDPKKKATF RAITSTLASS FKRRRSSKDT     900
SIGGGRGALQ NQKDIVLPRR AIEREEGQLQ LCSRHRES                             938
```

SEQ ID NO: 189 Human Glutamate Ionotropic Receptor NMDA Type
       Subunit 1 (GRIN1) amino acid, isoform GluN1-2a (NP_067544.1)

```
MSTMRLLTLA LLFSCSVARA ACDPKIVNIG AVLSTRKHEQ MFREAVNQAN KRHGSWKIQL      60
NATSVIHKPN AIQMALSVCE DLISSQVYAI LVSHPPIPND HFIPTPVSYT AGFYRIPVLG     120
```

TABLE 2-continued

```
LTIRMSIYD KSIHLSFLRT VPPYSHQSSV WFEMMRVYSW NHIILLVSDD HEGRAAQKRL    180
ETLLEERESK AEKVLQFDPG TKNVTALLME AKELEARVII LSASEDDAAT VYRAAAMLNM    240
TGSGYVWLVG EREISGNALR YAPDGILGLQ LINGKNESAH ISDAVGVVAQ AVHELLEKEN    300
ITDPPRGCVG NTNIWKTGPL FKRVLMSSKY ADGVTGRVEF NEDGDRKFAN YSIMNLQNRK    360
LVQVGIYNGT HVIPNDRKII WPGGETEKPR GYQMSTRLKI VTIHQEPFVY VKPTLSDGTC    420
KEEFTVNGDP VKKVICTGPN DTSPGSPRHT VPQCCYGFCI DLLIKLARTM NFTYEVHLVA    480
DGKEGTQERV NNSNKKEWNG MMGELLSGQA DMIVAPLTIN NERAQYIEFS KPFKYQGLTI    540
LVKKEIPRST LDSFMQPFQS TLWLLVGLSV HVVAVMLYLL DRFSPFGRFK VNSEEEEEDA    600
LTLSSAMWFS WGVLLNSGIG EGAPRSFSAR ILGMVWAGFA MIIVASYTAN LAAFLVLDRP    660
EERITGINDP RLRNPSDKFI YATVKQSSVD IYFRRQVELS TMYRHMEKHN YESAAEAIQA    720
VRDNKLHAFI WDSAVLEFEA SQKCDLVTTG ELFFRSGFGI GMRKDSPWKQ NVSLSILKSH    780
ENGFMEDLDK TWVRYQECDS RSNAPATLIT ENMAGVFMLV AGGIVAGIFL IFIEIAYKRH    840
KDARRKQMQL AFAAVNVWRK NLQSTGGGRG ALQNQKDTVL PRRAIEREEG QLQLCSRHRE    900
S                                                                  901
```

SEQ ID NO: 190 Human Glutamate Ionotropic Receptor NMDA Type
Subunit 1 (GRIN1) amino acid, isoform GluN1-3b (NP_001172019.1)

```
MSTMRLLTLA LLFSCSVARA ACDPKIVNIG AVLSTRKHEQ MFREAVNQAN KRHGSWKIQL     60
NATSVTHKPN AIQMALSVCE DLISSQVYAI LVSHPPTPND HFITTPVSYT AGFYRIPVLG    120
LTIRMSIYSD KSIHLSFLRT VPPYSHQSSV WFEMMRVYSW NHIILLVSDD HEGRAAQKRL    180
ETLLEERESK SKKRNYENLD QLSYDNKRGP KAEKVLQFDP GTKNVTALLM EAKELEARVI    240
ILSASEDDAA TVYRAAAMLN MTGSGYVWLV GEREISGNAL RYAPDGILGL QLINGKNESA    300
HISDAVGVVA QAVHELLEKE NITDPPRGCV GNTNIWKTGP LFKRVLMSSK YADGVTGRVE    360
FNEDGDRKFA NYSIMNLQNR KLVQVGIYNG THVIPNDRKI IWPGGETEKP RGYQMSTRLK    420
IVTIHQEPFV YVKPTLSDGT CKEEFTVNGD PVKKVICTGP NDTSPGSPRH TVPQCCYGFC    480
IDLLIKLART MNFTYEVHLV ADGKEGTQER VNNSNKKEWN GMMGELLSGQ ADMIVAPLTI    540
NNERAQYIEF SKPFKYQGLT ILVKKEIPRS TLDSFMQPFQ STLWLLVGLS VHVVAVMLYL    600
LDRFSPFGRF KVNSEEEEED ALTLSSAMWF SWGVLLNSGI GEGAPRSFSA RILGMVWAGF    660
AMIIVASYTA NLAAFLVLDR PEERITGIND PRLRNPSDKF IYATVKQSSV DIYFRRQVEL    720
STMYRHMEKH NYESAAEAIQ AVRDNKLHAF IWDSAVLEFE ASQKCDLVTT GELFFRSGFG    780
IGMRKDSPWK QNVSLSILKS HENGFMEDLD KTWVRYQECD SRSNAPATLT FENMAGVFML    840
VAGGIVAGIF LIFIEIAYKR HKDARRKQMQ LAFAAVNVWR KNLQDRKSGR AEPDPKKKAT    900
FRAITSTLAS SFKRRRSSKD TQYHPTDITG PLNLSDPSVS TVV                     943
```

SEQ ID NO: 191 Human Glutamate Ionotropic Receptor NMDA Type
Subunit 1 (GRIN1) amino acid, isoform GluN1-4a (NP_000823.4)

```
MSTMRLLTLA LLFSCSVARA ACDPKIVNIG AVLSTRKHEQ MFREAVNQAN KRHGSWKIQL     60
NATSVTHKPN AIQMALSVCE DLISSQVYAI LVSHPPTPND HFITTPVSYT AGFYRIPVLG    120
LTIRMSIYSD KSIHLSFLRT VPPYSHQSSV WFEMMRVYSW NHIILLVSDD HEGRAAQKRL    180
ETLLEERESK AEKVLQFDPG TKNVTALLME AKELEARVII LSASEDDAAT VYRAAAMLNM    240
TGSGYVWLVG EREISGNALR YAPDGILGLQ LINGKNESAH ISDAVGVVAQ AVHELLEKEN    300
ITDPPRGCVG NTNIWKTGPL FKRVLMSSKY ADGVTGRVEF NEDGDRKFAN YSIMNLQNRK    360
LVQVGIYNGT HVIPNDRKII WPGGETEKPR GYQMSTRLKI VTIHQEPFVY VKPTLSDGTC    420
KEEFTVNGDP VKKVICTGPN DTSPGSPRHT VPQCCYGFCI DLLIKLARTM NFTYEVHLVA    480
DGKEGTQERV NNSNKKEWNG MMGELLSGQA DMIVAPLTIN NERAQYIEFS KPFKYQGLTI    540
LVKKEIPRST LDSFMQPFQS TLWLLVGLSV HVVAVMLYLL DRFSPFGRFK VNSEEEEEDA    600
LTLSSAMWFS WGVLLNSGIG EGAPRSFSAR ILGMVWAGFA MIIVASYTAN LAAFLVLDRP    660
EERITGINDP RLRNPSDKFI YATVKQSSVD IYFRRQVELS TMYRHMEKHN YESAAEAIQA    720
VRDNKLHAFI WDSAVLEFEA SQKCDLVTTG ELFFRSGFGI GMRKDSPWKQ NVSLSILKSH    780
ENGFMEDLDK TWVRYQECDS RSNAPATLIT ENMAGVFMLV AGGIVAGIFL IFIEIAYKRH    840
KDARRKQMQL AFAAVNVWRK NLQQYHPTDI TGPLNLSDPS VSTVV                   885
```

SEQ ID NO: 192 Human Glutamate Ionotropic Receptor NMDA Type
Subunit 1 (GRIN1) amino acid, isoform GluN1-5b (NP_001172020.1)

```
MSTMRLLTLA LLFSCSVARA ACDPKIVNIG AVLSTRKHEQ MFREAVNQAN KRHGSWKIQL     60
NATSVTHKPN AIQMALSVCE DLISSQVYAI LVSHPPTPND HFITTPVSYT AGFYRIPVLG    120
LTIRMSIYSD KSIHLSFLRT VPPYSHQSSV WFEMMRVYSW NHIILLVSDD HEGRAAQKRL    180
ETLLEERESK SKKRNYENLD QLSYDNKRGP KAEKVLQFDP GTKNVTALLM EAKELEARVI    240
ILSASEDDAA TVYRAAAMLN MTGSGYVWLV GEREISGNAL RYAPDGILGL QLINGKNESA    300
HISDAVGVVA QAVHELLEKE NITDPPRGCV GNTNIWKTGP LFKRVLMSSK YADGVTGRVE    360
FNEDGDRKFA NYSIMNLQNR KLVQVGIYNG THVIPNDRKI IWPGGETEKP RGYQMSTRLK    420
IVTIHQEPFV YVKPTLSDGT CKEEFTVNGD PVKKVICTGP NDTSPGSPRH TVPQCCYGFC    480
IDLLIKLART MNFTYEVHLV ADGKEGTQER VNNSNKKEWN GMMGELLSGQ ADMIVAPLTI    540
NNERAQYIEF SKPFKYQGLT ILVKKEIPRS TLDSFMQPFQ STLWLLVGLS VHVVAVMLYL    600
LDRFSPFGRF KVNSEEEEED ALTLSSAMWF SWGVLLNSGI GEGAPRSFSA RILGMVWAGF    660
AMIIVASYTA NLAAFLVLDR PEERITGIND PRLRNPSDKF IYATVKQSSV DIYFRRQVEL    720
STMYRHMEKH NYESAAEAIQ AVRDNKLHAF IWDSAVLEFE ASQKCDLVIT GELFFRSGFG    780
IGMRKDSPWK QNVSLSILKS HENGFMEDLD KTWVRYQECD SRSNAPAILT FENMAGVFML    840
VAGGIVAGIF LIFIEIAYKR HKDARRKQMQ LAFAAVNVWR KNLQQYHPID ITGPLNLSDP    900
SVSTVV                                                             906
```

SEQ ID NO: 193 Human FRK tyrosine-protein kinase cDNA (NM_002031.2)

```
atgagcaaca tctgtcagag gctctgggag tacctagaac cctatctccc ctgtttgtcc     60
acggaggcag acaagtcaac cgtgattgaa aatccagggg cccttttgctc tccccagtca    120
cagaggcatg gccactactt tgtggctttg tttgattacc aggctcggac tgctgaggac    180
ttgagcttcc gagcaggtga caaacttcaa gttctggaca ctttgcatga gggctggtgg    240
```

TABLE 2-continued

```
tttgccagac acttggagaa aagacgagat ggctccagtc agcaactaca aggctatatt    300
ccttctaact acgtggctga ggacagaagc ctacaggcag agccgtggtt ctttggagca    360
atcggaagat cagatgcaga gaaacaacta ttatattcag aaaacaagac cggttccttt    420
ctaatcagag aaaagtgaaag ccaaaaagga gaattctctc tttcagtttt agatgggaca   480
gttgtaaaac actacagaat taaaagactg gatgaagggg gatttttcct cacgcgaaga    540
agaatctttt caacactgaa cgaatttgtg agccactaca ccaagacaag tgacggcctg    600
tgtgtcaagc tggggaaacc atgcttaaag atccaggtcc cagctccatt tgatttgtcg    660
tataaaaccg tggaccaatg ggagatagac cgcaactcca tacagcttct gaagcgattg    720
ggatctggtc agtttggcga agtatgggaa ggtctgtgga acaataccac tccagtagca    780
gtgaaaacat taaaaccagg ttcaatggat ccaaatgact tcctgaggga ggcacagata    840
atgaagaacc taagacatcc aaagcttatc cagctttatg ctgtttgcac tttagaagat    900
ccaattata ttattacaga gttgatgaga catggaagtc tgcaagaata tctccaaaat    960
gacactggat caaaaatcca tctgactcaa caggtagaca tggcggcaca ggttgcctct   1020
ggaatggcct atctggagtc tcggaactac attcacagag atctggctgc cagaaatgtc   1080
ctcgttggtg aacataatat ctacaaagta gcagattttg gacttgccag agttttaag    1140
gtagataatg aagacatcta tgaatctaga cacgaaataa agctgccggt gaagtggact   1200
gcgcccgaag ccattcgtag taataaattc agcattaagt ccgatgtatg gtcatttgga   1260
atccttcttt atgaaatcat tacttatggc aaaaatgcct tacagtggtat gacaggtgcc   1320
caggtaatcc agatgttggc tcaaaactat agacttccgc aaccatccaa ctgtccacag   1380
caattttaca acatcatgtt ggagtgctgg aatgcagagc taaggaacg acctacattt     1440
gagacactgc gttggaaact tgaagactat tttgaaacga actcttcata ttcagatgca   1500
aataacttca taagatga                                                 1518
```

SEQ ID NO: 194 Human FRK tyrosine-protein kinase amino acid sequence
(NP_002022.1)

```
MSNICQRLWE YLEPYLPCLS TEADKSTVIE NPGALCSPQS QRHGHYFVAL FDYQARTAED    60
LSFRAGDKLQ VLDILHEGWW FARHLEKRRD GSSQQLQGYI PSNYVAEDRS LQAEPWFFGA   120
IGRSDAEKQL LYSENKTGSF LIRESESQKG EFSLSVLDGA VVKHYRIKRL DEGGFFLIRR   180
RIFSTLNEFV SHYTKISDGL CVKLGKPCLK IQVPAPFDLS YKTVDQWEID RNSIQLLKRL   240
GSGQFGEVWE GLWNNTIPVA VKILKPGSMD PNDFLREAQI MKNLRHPKLI QLYAVCILED   300
PIYIITELMR HGSLQEYLQN DIGSKIHLIQ QVDMAAQVAS GMAYLESRNY IHRDLAARNV   360
LVGEHNIYKV ADFGLARVFK VDNEDIYESR HEIKLPVKWT APEAIRSNKF SIKSDVWSFG   420
ILLYEIITYG KMPYSGMTGA QVIQMLAQNY RLPQPSNCPQ QFYNIMLECW NAEPKERPTF   480
ETLRWKLEDY FETDSSYSDA NNFIR                                        505
```

SEQ ID NO: 195 Mouse FRK tyrosine-protein kinase cDNA, transcript
variant 1 (NM_001159544.1)

```
atgggcagcg tctgtgtgag actctgggca tacctgcagc ttttctccc gtgctggtct     60
caagaggcag acaagtcagt agtaattgag aatccagggg cctctgtcc cccagaggct   120
cccaggtcac aagagcccga gagaagccat ggccagtatt ttgtggctct gtttgattac   180
caagcacgta ctgcagagga cctgagcttc cgtgccggcg acaaactcca agtcttggac   240
acttcgcatg agggctggtg gttggccaga catttggaga agaagggaac cggcttaggt   300
cagcagctac agggctacat tccttccaat tacgtggcgg aggaccggag tctccaggca   360
gagccgtggt tttttggagc aatcaaaaga gcagatgcaa aaaaacaact tctgtattca   420
gaaaaccaga cgggcgcctt tctaatcaga gagagtgaga gccagaaggg tgactttccc   480
ctctcagttt tagatgaagg tgttgtaaaa cactacagaa taagaaggtt ggatgaaggt   540
ggcttcttcc tcaccaggag gaaagtcttt tcaaccctga tgaattcgt gaactactac    600
accacaacaa gtgacgggct gtgtgtcaag ctggagaagc catgcttaaa gatccaggta   660
ccaaccccctt ttgatttgtc atataaaact gcagaccagt gggagataga ccgcaactcc   720
atacagcttt tgaagcgact gggatctggt cagtttggag aagtttggga aggtctgtgg   780
aataatacca ctccagtggc cgtaaaaacg ttaaaaccag gttcaatgga tccaaatgac   840
ttcctgaggg aggcacagat aatgaagagc ctaagacacc caaaaactcat ccagctctat   900
gctgtttgca ctttagaaga tcccattat attattacag agttgatgag acatggaagc   960
ctgcaagaat atctccaaaa tgatggtggg tcaaaaatcc atttgattca acaggtagac   1020
atggcggcac aggtggcttc tggaatggcct atcttgagt cgcagaacta tattcacaga   1080
gatctggctg caagaaatgt ccttgttggt gaacataata tctacaaagt agcagatttt   1140
ggacttgcaa gagtttttaa ggtagataat aagacatct atgaatctaa acacgaaata   1200
aagctgccag tgaagtggac tgcacccgaa gccattcgta ctaataaatt cagcattaag   1260
tctgatgtgt ggtcttttgg aatcctgctc tatgaaatca ttacttatgg caaaatgcct   1320
tacagtggta tgacaggtgc tcaagtaatt caaatgttga gtcaaaacta cagcttcca    1380
cagccatcta actgcccaca gcaattctac agcatcatgc tagagtgctg gaatgttgag   1440
cctaagcaac ggccaacatt tgagaccctg cattggaaac ttgaagacta ctttgaaaca   1500
gactgttcct attcagatac aaataacttc ataaactaa                          1539
```

SEQ ID NO: 196 Mouse FRK tyrosine-protein kinase cDNA, transcript
variant 2 (NM_010237.3)

```
atgggcagcg tctgtgtgag actctgggca tacctgcagc ttttctccc gtgctggtct     60
caagaggcag acaagtcagt agtaattgag aatccagggg cctctgtcc cccagaggct   120
cccaggtcac aagagcccga gagaagccat ggccagtatt ttgtggctct gtttgattac   180
caagcacgta ctgcagagga cctgagcttc cgtgccggcg acaaactcca agtcttggac   240
acttcgcatg agggctggtg gttggccaga catttggaga agaagggaac cggcttaggt   300
cagcagctac agggctacat tccttccaat tacgtggcgg aggaccggag tctccaggca   360
gagccgtggt tttttggagc aatcaaaaga gcagatgcaa aaaaacaact tctgtattca   420
gaaaaccaga cgggcgcctt tctaatcaga gagagtgaga gccagaaggg tgactttccc   480
ctctcagttt tagatgaagg tgttgtaaaa cactacagaa taagaaggtt ggatgaaggt   540
ggcttcttcc tcaccaggag gaaagtcttt tcaaccctga tgaattcgt gaactactac    600
accacaacaa gtgacgggct gtgtgtcaag ctggagaagc catgcttaaa gatccaggta   660
```

TABLE 2-continued

```
ccaacccctt tgatttgtc atataaaact gcagaccagt gggagataga ccgcaactcc    720
atacagcttt tgaagcgact gggatctggt cagtttggag aagtttggga aggtctgtgg    780
aataatacca ctccagtggc cgtaaaaacg ttaaaaccag gttcaatgga tccaaatgac    840
ttcctgaggg aggcacagat aatgaagagc ctaagcaccc caaaactcat ccagctctat    900
gctgtttgca ctttagaaga tcccatttat attattacag agttgatgag acatggaagc    960
ctgcaagaat atctccaaaa tgatggtggg tcaaaaatcc atttgattca acaggtagac   1020
atggcggcac aggtggcttc tggaatggcc tatcttgagt cgcagaacta tattcacaga   1080
gatctggctg caagaaatgt ccttgttggt gaacataata tctacaaagt agcagatttt   1140
ggacttgcaa gagttttaa ggtagataat gaagacatct atgaatctaa acacgaaata   1200
aagctgccag tgaagtggac tgcacccgaa gccattcgta ctaataaatt cagcattaag   1260
tctgatgtgt ggtcttttgg aatcctgctc tatgaaatca ttacttatgg caaaatgcct   1320
tacagtggta tgacaggtgc tcaagtaatt caaatgttga gtcaaaacta cagacttcca   1380
cagccatcta actgcccaca gcaattctac agcatcatgc tagagtgctg gaatgttgag   1440
cctaagcaac ggccaacatt tgagaccctg cattggaaac ttgaagacta cttgaaaca    1500
gactgttcct attcagatac aaataacttc ataaactaa                          1539
```

SEQ ID NO: 197 Mouse FRK tyrosine-protein kinase amino acid sequence (NP_034367.2)

```
MGSVCVRLWA YLQPFLPCWS QEADKSVVIE NPGAFCPPEA PRSQEPERSH GQYFVALFDY    60
QARTAEDLSF RAGDKLQVLD ISHEGWWLAR HLEKKGIGLG QQLQGYIPSN YVAEDRSLQA   120
EPWFFGAIKR ADAEKQLLYS ENQTGAFLIR ESESQKGDFS LSVLDEGVVK HYRIRRLDEG   180
GEFLIRRKVF STLNEFVNYY TITSDGLCVK LEKPCLKIQV PIPFDLSYKT ADQWEIDRNS   240
IQLLKRLGSG QFGEVWEGLW NNTIPVAVKI LKPGSMDPND FLREAQIMKS LRHPKLIQLY   300
AVCILEDPIY IITELMRHGS LQEYLQNDGG SKIHLIQQVD MAAQVASGMA YLESQNYIHR   360
DLAARNVLVG EHNIYKVADF GLARVFKVDN EDIYESKHEI KLPVKWIAPE AIRINKFSIK   420
SDVWSFGILL YEIITYGKMP YSGMTGAQVI QMLSQNYRLP QPSNCPQQFY SIMLECWNVE   480
PKQRPTFEIL HWKLEDYFET DCSYSDINNF IN                                512
```

SEQ ID NO: 198 Mouse FRK tyrosine-protein kinase amino acid sequence (NP_001153016.1)

```
MGSVCVRLWA YLQPFLPCWS QEADKSVVIE NPGAFCPPEA PRSQEPERSH GQYFVALFDY    60
QARTAEDLSF RAGDKLQVLD ISHEGWWLAR HLEKKGIGLG QQLQGYIPSN YVAEDRSLQA   120
EPWFFGAIKR ADAEKQLLYS ENQTGAFLIR ESESQKGDFS LSVLDEGVVK HYRIRRLDEG   180
GEFLIRRKVF STLNEFVNYY TITSDGLCVK LEKPCLKIQV PIPFDLSYKT ADQWEIDRNS   240
IQLLKRLGSG QFGEVWEGLW NNTIPVAVKI LKPGSMDPND FLREAQIMKS LRHPKLIQLY   300
AVCILEDPIY IITELMRHGS LQEYLQNDGG SKIHLIQQVD MAAQVASGMA YLESQNYIHR   360
DLAARNVLVG EHNIYKVADF GLARVFKVDN EDIYESKHEI KLPVKWIAPE AIRINKFSIK   420
SDVWSFGILL YEIITYGKMP YSGMTGAQVI QMLSQNYRLP QPSNCPQQFY SIMLECWNVE   480
PKQRPTFEIL HWKLEDYFET DCSYSDINNF IN                                512
```

SEQ ID NO: 199 Human BLK proto-oncogene cDNA (NM_001715.2)

```
atggggctgg taagtagcaa aaagccggac aaggaaaagc cgatcaaaga aaggacaag     60
ggccaatgga gccccctgaa ggtcagcgcc caagacaagg atgcccccgc actgccgccc   120
ctggttgtct tcaaccacct tactcctcca ccgcccgatg aacacctgga tgaagacaag   180
catttcgtgg tggctctgta tgactacacc gctatgaatg atcgggacct gcagatgctg   240
aagggggaga agctacaggt cctgaaggga actggagact ggtggctggc caggtcactc   300
gtcacaggaa gagaaggcta tgtgcccagt aactttgtgg ccgagtgga gagcctgaa    360
atggaaaggt ggttctttag atcacagggt cggaaggagg ctgagaggca gcttcttgct   420
ccaatcaaca aggccggctc ctttcttatc agagagagtg aaaccaacaa aggtgccttc   480
tccctgtctg tgaaggatgt caccacccag ggggagctga tcaagcacta taagatccgc   540
tgcctggatg aagggggcta ctacatctcc ccccggatca ccttcccctc gctccaggcc   600
ctggtgcagc actattctaa gaaggggat ggtctatgcc agaggctgac cctgccctgt   660
gtgcgcccgg ccccgcagaa tcctgggcc caggatgaat gggagatccc ccggcagtct   720
ctcaggctg tcaggaaact cggtctgga caattcggcg aagtctggat gggttactac   780
aaaaacaaca tgaaggtggc cattaagacg ctgaaggagg gaaccatgtc tccagaagcc   840
tttctgggtg aggccaacgt gatgaaggct ctgcagcacg agcggctggt ccgactctac   900
gcagtggtca ccaaggagcc catctacatt gtcaccgagt acatggccag aggatgcctg   960
ctggatttcc tgaagacaga tgaagggagc agattgtcac tcccaaggct gattgacatg  1020
tcggcgcaga ttgctgaagg gatggcatac attgagcgca tgaattccat ccaccgcgac  1080
ctgcggggcg ccaacatcct ggtgtctgag gccttgtgct gcaaaattgc tgattttgat  1140
ttggctcgaa tcatcgacag tgaatacacg gcccaagagg gggccaagtt cccatcaag   1200
tggacagccc cggaagccat ccactcggg gtcttcacca tcaaagcaga cgtgtggtcg   1260
tttgagtcc tcctgatgga agttgtcact tatgggcggg tgccataccc agggatgagc   1320
aaccccgagg tcatccgcaa cctggagcgc ggctaccgca tgccgcgcc cgacacctgc   1380
ccgcccgagc tgtaccgcgg cgtcatcgcc gagtgctggc gcagccgccc cgaggagcgg  1440
cccaccttcg agttcctgca gtcggtgctg gaggacttct acacggccac cgagcggcag  1500
tacgagctgc agccctag                                                1518
```

SEQ ID NO: 200 Human BLK proto-oncogene amino acid sequence (NP_001706.2)

```
MGLVSSKKPD KEKPIKEKDK GQWSPLKVSA QDKDAPPLPP LVVENHLIPP PDEHLDEDK    60
HFVVALYDYT AMNDRDLQML KGEKLQVLKG TGDWWLARSL VTGREGYVPS NFVARVESLE   120
MERWFFRSQG RKEAERQLLA PINKAGSFLI RESEINKGAF SLSVKDVTIQ GELIKHYKIR   180
CLDEGGYYIS PRITTPSLQA LVQHYSKKGD GLCQRLILPC VRPAPQNPWA QDEWEIPRQS   240
LRLVRKLGSG QFGEVWMGYY KNNMKVAIKT LKEGIMSPEA FLGEANVMKA LQHERLVRLY   300
AVVIKEPIYI VITYMARGCL LDFLKIDEGS RLSLPRLIDM SAQIAEGMAY IERMNSIHRD   360
```

TABLE 2-continued

| LRAANILVSE ALCCKIADFG LARIIDSEYT AQEGAKFPIK WIAPEAIHFG VETIKADVWS | 420 |
| FGVLLMEVVI YGRVPYPGMS NPEVIRNLER GYAMPRPDTC PPELYRGVIA ECWRSRPEER | 480 |
| PIFEFLQSVL EDFYTATERQ YELQP | 505 |

SEQ ID NO: 201 Mouse BLK proto-oncogene cDNA (NM_007549.2)

```
atgggctgc tgagcagcaa gaggcaggtc agtgagaagg gcaagggctg gagcccgtg     60
aagatccgca cccaggacaa ggctccccca cccctgccac ccctggttgt cttcaaccac   120
cttgccccac catctcctaa ccaggaccca gatgaagagg agcgttttgt ggtggctctg   180
tttgactatg ccgctgtgaa tgacagggac cttcaggtgc tgaagggtga aagctccag   240
gtcttgagga gcactggaga ctggtggttg gccaggtcac tcgtcacagg aagagaaggt   300
tatgtgccca gaactttgt ggccccagta gagactctgg aagtagaaaa atggttcttc   360
aggaccatca gccggaagga tgctgagagg cagttgctgg ctccgatgaa caaggccggc   420
tcctttctca tcagagagag tgagagcaat aaaggtgcct tttccctgtc cgtgaaagat   480
atcaccaccc aggggaggt ggtcaagcac tataagatcc gatcactgga caatggaggc   540
tattacatct ccccccggat cacctttccc accctccagg ccctggtgca gcactattca   600
aagaaagggg atggtttgtg tcagaagttg actctgccct gtgtgaacct ggccccgaag   660
aacctttggg cccaagatga atgggaaatc cccaggcagt ctctcaagtt ggtccggaaa   720
cttgggtctg gcagtttgg cgaagtctgg atgggttatt acaaaaataa catgaaggtg   780
gccatcaaga ccctgaagga gggaaccatg tcaccggaag ctttcctggg cgaggccaac   840
gtgatgaaaa ccctgcagca tgagaggctg gttcgtctct acgctgtggt caccagagag   900
cccatttaca tcgtcactga atacatggcc agaggtgct tgctggattt tctgaagacc   960
gatgaagtga caggttgtc ccttccaagg ctgattgaca tgtcagccca ggttgcagag  1020
gggatggctt acatagagcg catgaattcc atccaccgtg acctgcgggc agccaacatc  1080
ctggtgtctg agacgttgtg ctgcaaaatc gctgacttcg gcttggccag gatcattgac  1140
agtgaataca ctgcccaaga ggggccaag ttccccatca agtggaccgc cccgaggcc   1200
atccacttcg gggtgtttac catcaaggct gatgtgtggt ccttcggagg tcttgctgatg  1260
gagattgtca cctatgggcg cgttccctac ccaggaatga gcaaccctga ggtcatccgt  1320
agcctggagc acggctaccg aatgccatgc ccggagacat gtccaccgga gttgtacaat  1380
gatatcatca ctgagtgctg gcggggccgg ccagaggagc ggcctacctt tgagttcctg  1440
cagtcggtgt tggaggactt ctacacagcc acggagggcc aatatgagct gcagccctag  1500
```

SEQ ID NO: 202 Mouse BLK proto-oncogene amino acid sequence
(NP_031575.2)

| MGLLSSKRQV SEKGKGWSPV KIRTQDKAPP PLPPLVVFNH LAPPSPNQDP DEEERFVVAL | 60 |
| FDYAAVNDRD LQVLKGEKLQ VLRSTGDWWL ARSLVTGREG YVPSNFVAPV ETLEVEKWFF | 120 |
| RTISRKDAER QLLAPMNKAG SFLIRESESN KGAFSLSVKD ITTQGEVVKH YKIRSLDNGG | 180 |
| YYISPRITFP TLQALVQHYS KKGDGLCQKL ILPCVNLAPK NLWAQDEWEI PRQSLKLVRK | 240 |
| LGSGQFGEVW MGYYKNNMKV AIKILKEGTM SPEAFLGEAN VMKTLQHERL VRLYAVVIRE | 300 |
| PIYIVITYMA RGCLLDFLKT DEGSRLSLPR LIDMSAQVAE GMAYIERMNS IHRDLRAANI | 360 |
| LVSETLCCKI ADFGLARIID SEYTAQEGAK FPIKWIAPEA IHEGVETIKA DVWSFGVLLM | 420 |
| EIVTYGRVPY PGMSNPEVIR SLEHGYRMPC PETCPPELYN DIITECWRGR PEERPTFEFL | 480 |
| QSVLEDFYIA TEGQYELQP | 499 |

SEQ ID NO: 203 Human FYN proto-oncogene cDNA, transcript variant 1
(NM_002037.5)

```
atgggctgtg tgcaatgtaa ggataaagaa gcaacaaaac tgacggagga gagggacggc    60
agcctgaacc agagctctgg gtaccgctat ggcacagacc ccaccctca gcactacccc   120
agcttcggtg tgacctccat ccccaactac aacaacttcc acgcagccgg ggccaagga   180
ctcaccgtct ttggaggtgt gaactcttcg tctcatacgg ggaccttgcg tacgagagga   240
ggaacggtga tgcactcttt tgtgccctt tatgactatg aagcacggac agaagatgac   300
ctgagttttc acaaaggaga aaaatttcaa atattgaaca gctcggaagg agattggtgg   360
gaagcccgct ccttgacaac tggagagaca ggttacattc cagcaattag tgtggctcca   420
gttgactcta tccaggcaga agagtggtac tttggaaaac ttggccgaaa agatgctgag   480
cgacagctat tgtcctttgg aaacccaaga ggtacccttc ttatccgcga gagtgaaacc   540
accaaaggtg cctattcact ttctatccgt gattgggatg atatgaaagg agaccatgtc   600
aaacattata aaattcgcaa acttgacaat ggtggatact acattaccac ccgggcccag   660
tttgaaacac ttcagcagct tgtacaacat tactcagaga gagctgcagg tctctgctgc   720
cgcctagtag ttccctgtca aagggatgc caaggcttta ccgatctgtc tgtcaaaacc   780
aaagatgtct gggaatccc tcgagaatcc tgcagttga tcaagagact gggaaatggg   840
cagtttgggg aagtatggat gggtacctgg aatggaaaca caaagtagc cataaagact   900
cttaaaccag gcacaatgtc ccccgaatca ttccttgagg aagcgcagat catgaagaag   960
ctgaagcacg acaagctggt ccagctctat gcagtggtgt ctgaggagcc catctacatc  1020
gtcaccgagt atatgaacaa aggaagttta ctggatttct taaagatgg agaaggaaga  1080
gctctgaaat taccaaatct tgtggacatg gcagcacagg tggctgcagg aatggcttac  1140
atcgagcgca tgaattatat ccatagagat ctgcgatcac aaacattcat agtggggaat  1200
ggactcatat gcaagattgc tgacttcgga ttggccgat tgataagaa caatgagtac  1260
acagcaagac aagtgcaaa gttccccatc aagtggacgg ccccgaggc agccctgtac  1320
ggaggttca caatcaagtc tgacgtgtgg tctttttgga aa tcttactcac agagctggtc  1380
accaaaggaa gagtgccata cccaggcatg aacaaccggg aggtgctgga gcaggtggag  1440
cgaggctaca ggatgcctg cccgcaggac tgccccatct ctctgcatga gctcatgatc  1500
cactgctgga aaaaggaccc tgaagaacgc cccacttttg agtacttgca gagcttcctg  1560
gaagactact ttaccgcgac agagcccag taccaacctg gtgaaaacct gtaa          1614
```

TABLE 2-continued

SEQ ID NO: 204 Human FYN proto-oncogene cDNA, transcript variant 2
(NM_153047.3)

```
atgggctgtg tgcaatgtaa ggataaagaa gcaacaaaac tgacggagga gagggacggc      60
agcctgaacc agagctctgg gtaccgctat ggcacagacc ccaccctca gcactacccc      120
agcttcggtg tgacctccat ccccaactac aacaacttcc acgcagccgg gggcaagga      180
ctcaccgtct ttggaggtgt gaactcttcg tctcatacgg ggaccttgcg tacgagagga      240
ggaacaggag tgacactctt tgtggccctt tatgactatg aagcacggac agaagatgac      300
ctgagttttc acaaggaga aaaatttcaa atattgaaca gctcggaagg agattggtgg      360
gaagcccgct ccttgacaac tggagagaca ggttacattc ccagcaatta tgtggctcca      420
gttgactcta tccaggcaga agagtggtac tttggaaaac ttggccgaaa agatgctgag      480
cgacagctat tgtcctttgg aaacccaaga ggtaccttc ttatccgcga gagtgaaacc      540
accaaaggtg cctattcact ttctatccgt gattgggatg atatgaaagg agaccatgtc      600
aaacattata aaattcgcaa acttgacaat ggtggatact acattaccac ccgggcccag      660
tttgaaacac ttcagcagct tgtacaacat tactcagaga agctgatgg tttgtgtttt      720
aacttaactg tgattgcatc gagttgtacc ccacaaactc tggattggtc taaagatgct      780
tgggaagttg cacgtcgttc gttgtgtctg gagaagaagc tgggtcaggg gtgtttcgct      840
gaagtgtggc ttggtacctg aatggaaac acaaagtag ccataaagac tcttaaacca      900
ggcacaatgt cccccgaatc attccttgag gaagcgcaga tcatgaagaa gctgaagcac      960
gacaagctgg tccagctcta tgcagtggtg tctgaggagc ccatctacat cgtcacgag      1020
tatatgaaca aaggaagttt actggatttc ttaaagagat gagaaggaag agctctgaaa      1080
ttaccaaatc ttgtggacat ggcagcacag gtggctgcag aatggcttta catcgagcgc      1140
atgaattata tccatagaga tctgcgatca gcaaacattc tagtgggaa tggactcata      1200
tgcaagattg ctgacttcgg attggccga ttgatagaag acaatgagta cacagcaaga      1260
caaggtgcaa agttcccat caagtggacg gccccgagg cagccctgta cggggaggttc      1320
acaatcaagt ctgacgtgtg gtcttttgga atcttactca cagagctggt caccaaagga      1380
agagtgccat acccaggcat gaacaaccgg gaggtgctgg agcaggtgga gcgaggctac      1440
aggatgcct gcccgcagga ctgccccatc tctctgcatg agctcatgat ccactgctgg      1500
aaaaaggacc ctgaagaacg ccccactttt gagtacttgc agagcttcct ggaagactac      1560
tttaccgcga cagagcccca gtaccaacct ggtgaaaacc tgtaa                      1605
```

SEQ ID NO: 205 Human FYN proto-oncogene cDNA, transcript variant 3
(NM_153048.3)

```
atgggctgtg tgcaatgtaa ggataaagaa gcaacaaaac tgacggagga gagggacggc      60
agcctgaacc agagctctgg gtaccgctat ggcacagacc ccaccctca gcactacccc      120
agcttcggtg tgacctccat ccccaactac aacaacttcc acgcagccgg gggcaagga      180
ctcaccgtct ttggaggtgt gaactcttcg tctcatacgg ggaccttgcg tacgagagga      240
ggaacaggag tgacactctt tgtggccctt tatgactatg aagcacggac agaagatgac      300
ctgagttttc acaaggaga aaaatttcaa atattgaaca gctcggaagg agattggtgg      360
gaagcccgct ccttgacaac tggagagaca ggttacattc ccagcaatta tgtggctcca      420
gttgactcta tccaggcaga agagtggtac tttggaaaac ttggccgaaa agatgctgag      480
cgacagctat tgtcctttgg aaacccaaga ggtaccttc ttatccgcga gagtgaaacc      540
accaaaggtg cctattcact ttctatccgt gattgggatg atatgaaagg agaccatgtc      600
aaacattata aaattcgcaa acttgacaat ggtggatact acattaccac ccgggcccag      660
tttgaaacac ttcagcagct tgtacaacat tactcaggta cctggaatgg aaacacaaaa      720
gtagccataa agactcttaa accaggcaca atgtcccccg aatcattcct tgaggaagcg      780
cagatcatga agaagctgaa gcacgacaag ctggtccagc tctatgcagt ggtgtctgag      840
gagcccatct acatcgtcac cgagtatatg aacaaaggaa gtttactgga tttcttaaaa      900
gatggagaag gaagctct gaaattacca aatcttgtgg acatggcagc acaggtggct      960
gcaggaatgc ttacatcga gcgcatgaat tatatccata gagatctgcg atcagcaaac      1020
attctagtgg ggaatggact catatgcaag attgctgact cggattggcc ccgattgata      1080
gaagacaatg agtacacagc aagacaaggt gcaaagttcc ccatcaagtg gacggccccc      1140
gaggcagccc tgtacgggag gttcacaatc aagtctgacg tgtggtcttt tggaatctta      1200
ctcacagagc tggtcaccaa aggaagagtg ccatacccag gcatgaacaa ccgggaggtg      1260
ctggagcagg tggagcgagg ctacaggatg ccctgcccgc aggactgccc catctctctg      1320
catgagctca tgatccactg ctggaaaaag gaccctgaag aacgccccac ttttgagtac      1380
ttgcagagct tcctggaaga ctactttacc gcgacagagc cccagtacca acctggtgaa      1440
aacctgtaa                                                              1449
```

SEQ ID NO: 206 Human FYN proto-oncogene amino acid sequence,
isoform a (NP_002028.1)

```
MGCVQCKDKE ATKLTEERDG SLNQSSGYRY GIDPIPQHYP SEGVISIPNY NNFHAAGGQG      60
LIVEGGVNSS SHIGILRIRG GIGVILEVAL YDYEARTEDD LSFHKGEKFQ ILNSSEGDWW     120
EARSLITGET GYIPSNYVAP VDSIQAEEWY FGKLGRKDAE RQLLSFGNPR GIFLIRESET    180
TKGAYSLSIR DWDDMKGDHV KHYKIRKLDN GGYYITTRAQ FETLQQLVQH YSERAAGLCC    240
RLVVPCHKGM PRLIDLSVKI KDVWEIPRES LQLIKRLGNG QFGEVWMGTW NGNIKVAIKT    300
LKPGIMSPES FLEEAQIMKK LKHDKLVQLY AVVSEEPIYI VITYMNKGSL LDFLKDGEGR    360
ALKLPNLVDM AAQVAAGMAY IERMNYIHRD LRSANILVGN GLICKIADFG LARLIEDNEY    420
TARQGAKFPI KWIAPEAALY GRFTIKSDVW SEGILLTELV TKGRVPYPGM NNREVLEQVE    480
RGYRMPCPQD CPISLHELMI HCWKKDPEER PIFEYLQSFL EDYFTATEPQ YQPGENL      537
```

SEQ ID NO: 207 Human FYN proto-oncogene amino acid sequence,
isoform b (NP_694592.1)

```
MGCVQCKDKE ATKLTEERDG SLNQSSGYRY GIDPIPQHYP SEGVISIPNY NNFHAAGGQG      60
LIVEGGVNSS SHIGILRIRG GIGVILEVAL YDYEARTEDD LSFHKGEKFQ ILNSSEGDWW     120
EARSLITGET GYIPSNYVAP VDSIQAEEWY FGKLGRKDAE RQLLSFGNPR GIFLIRESET    180
```

TABLE 2-continued

```
TKGAYSLSIR DWDDMKGDHV KHYKIRKLDN GGYYITTRAQ FETLQQLVQH YSEKADGLCF      240
NLIVIASSCT PQTSGLAKDA WEVARRSLCL EKKLGQGCFA EVWLGTWNGN TKVAIKILKP      300
GIMSPESFLE EAQIMKKLKH DKLVQLYAVV SEEPIYIVIE YMNKGSLLDF LKDGEGRALK      360
LPNLVDMAAQ VAAGMAYIER MNYIHRDLRS ANILVGNGLI CKIADFGLAR LIEDNEYTAR      420
QGAKFPIKWT APEAALYGRF TIKSDVWSFG ILLTELVIKG RVPYPGMNNR EVLEQVERGY      480
RMPCPQDCPI SLHELMIHCW KKDPEERPTF EYLQSFLEDY FTATEPQYQP GENL            534

SEQ ID NO: 208 Human FYN proto-oncogene amino acid sequence,
                           isoform c (NP_694593.1)

MGCVQCKDKE ATKLTEERDG SLNQSSGYRY GIDPIPQHYP SEGVISIPNY NNFHAAGGQG       60
LIVEGGVNSS SHIGILRIRG GIGVILEVAL YDYEARTEDD LSFHKGEKFQ ILNSSEGDWW      120
EARSLITGET GYIPSNYVAP VDSIQAEEWY FGKLGRKDAE RQLLSFGNPR GIFLIRESET     180
TKGAYSLSIR DWDDMKGDHV KHYKIRKLDN GGYYITTRAQ FETLQQLVQH YSGIWNGNIK      240
VAIKILKPGT MSPESFLEEA QIMKKLKHDK LVQLYAVVSE EPIYIVITYM NKGSLLDFLK      300
DGEGRALKLP NLVDMAAQVA AGMAYIERMN YIHRDLRSAN ILVGNGLICK IADFGLARLI      360
EDNEYTARQG AKFPIKWIAP EAALYGRFTI KSDVWSFGIL LTELVIKGRV PYPGMNNREV      420
LEQVERGYRM PCPQDCPISL HELMIHCWKK DPEERPTFEY LQSFLEDYFT ATEPQYQPGE      480
NL                                                                     482

SEQ ID NO: 209 Mouse FYN proto-oncogene cDNA, transcript variant 1
                             (NM_001122893.1)

atgggctgtg tgcaatgtaa ggataaagaa gcagcgaaac tgacagagga gagggacggc       60
agcctgaacc agagctctgg gtaccgctat ggcacagacc ccacccctca gcactacccc      120
agcttcggcg tgacctccat cccgaactac aacaacttcc acgcagctgg gggccaggga      180
ctcaccgtct ttgggggtgt gaactcctcc tctcacactg gaccctacg cacgagagga      240
gggacaggag tgacactgtt tgtggcgctt tatgactatg aagcacggac ggaagatgac      300
ctgagttttc acaaaggaga aaatttcaa atattgaaca gctcggaagg agactggtgg      360
gaagcccgct ccttgacaac cggggaaact ggttacattc cagcaatta cgtggctcca      420
gttgactcca tccaggcaga agagtggtac tttggaaaac ttggccgcaa agatgctgag      480
agacagctcc tgtcctttgg aaacccaaga ggtaccttc ttatccgcga gagcgaaacc      540
accaaaggtg cctactcact ttccatccgt gattgggatg atatgaaagg ggaccacgtc      600
aaacattata aaatccgcaa gcttgacaat ggtggatact atatcacaac gcgggcccag      660
tttgaaacac ttcagcaact ggtacagcat tactcagaga agctgatgg tttgtgtttt      720
aacttaactg tggtttcatc aagttgtacc ccacaaactc ctggattggc taaagatgct      780
tgggaagttg cacgtgactc gttgtttctg gagaagaagc tggggcaggg gtgtttcgct      840
gaagtgtggc ttggtacctg gaatggaaat acaaaagtag ccataaagac ccttaagcca      900
ggcaccatgt ctccggagtc cttcctggag gaggcgcaga tcatgaagaa gctgaagcat      960
gacaagctgg tgcagctcta cgcggtcgtg tctgaggagc ccatttacat cgtcacggag     1020
tacatgagca aaggaagttt gcttgacttc ttaaaagatg gtgaaggaag agctctgaag     1080
ttgccaaacc ttgtggacat ggcggcacag gttgctgcag gaatggctta catcgagcgc     1140
atgaattata tccacagaga tctgcgatca gcaaacattc tagtgggaaa tggactaatt     1200
tgcaagattg ctgactttgg attggctcgg ttgattgaag acaatgaata cacagcaaga     1260
caaggtgcga agtttcccat taagtggata gcccccgaag cggccctgta tggaaggttc     1320
acaatcaagt ctgacgtatg gtcttttgga atcttactca cagagctggt caccaaagga     1380
agagtgccat acccaggcat gaacaaccgg aggtgctgga gcaggtggag agaggctat     1440
```

(continued on next page)

TABLE 2-continued

```
aggatgccct gcccacagga ctgcccgatc tccctgcacg agctcatgat ccactgctgg   1500
aaaaaggatc cggaagagcg cccgaccttc gagtacttgc agggcttcct ggaggactac   1560
tttacggcca cagagcccca gtatcagccc ggtgaaaacc tgtga                   1605
```

SEQ ID NO: 211 Mouse FYN proto-oncogene cDNA, transcript variant 3
(NM_008054.2)

```
atgggctgtg tgcaatgtaa ggataaagaa gcagcgaaac tgacagagga gagggacggc     60
agcctgaacc agagctctgg gtaccgctat ggcacagacc ccaccctca gcactacccc     120
agcttcggcg tgacctccat cccgaactac aacaacttcc acgcagctgg gggccaggga    180
ctcaccgtct ttgggggtgt gaactcctcc tctcacactg gaccctacg cacgagagga    240
gggacaggag tgacactgtt tgtggcgctt tatgactatg aagcacggac ggaagatgac    300
ctgagttttc acaaaggaga aaaatttcaa atattgaaca gctcggaagg agactggtgg    360
gaagcccgct ccttgacaac cggggaaact ggttacattc ccagcaatta cgtggctcca    420
gttgactcca tccaggcaga agagtggtac tttggaaaac ttggccgcaa agatgctgag    480
agacagctcc tgtcctttgg aaacccaaga ggtacctttc ttatccgcga gagcgaaacc    540
accaaaggtg cctactcact ttccatccgt gattgggata atatgaaagg ggaccacgtc    600
aaacattata aaatccgcaa gcttgacaat ggtggatact atatcacaac gcgggcccag    660
tttgaaacac ttcagcaact ggtacagcat tactcagaga aagctgatgg tttgtgtttt    720
aacttaactg tggtttcatc aagttgtacc ccacaaactt ctggattggc taaagatgct    780
tgggaagttg cacgtgactc gttgtttctg gagaagaagc tggggcaggg gtgtttcgct    840
gaagtgtggc ttggtacctg gaatggaaat acaaaagtag ccataaagac ccttaagcca    900
ggcaccatgt ctccggagtc cttcctggaa gaggcgcaga tcatgaagaa gctgaagcat    960
gacaagctgg tgcagctcta cgcggtcgtg tctgaggagc ccatttacat cgtcacggag   1020
tacatgagca aaggaagttt gcttgacttc ttaaaagatg gtgaaggaag agctctgaag   1080
ttgccaaacc ttgtggacat ggcggcacag gttgctgcag gaatggctta catcgagcgc   1140
atgaattata tccacagaga tctgcgatca gcaaacattc tagtgggaaa tggactaatt   1200
tgcaagattg ctgactttgg attggctcgg ttgattgaag acaatgaata cacagcaaga   1260
caaggtgcga agtttcccat taagtggaca gcccccgaag cggccctgta tggaaggttc   1320
acaatcaagt ctgacgtatg gtcttttgga atcttactca caacaagga               1380
agagtgccat acccaggcat gaacaaccgg gaggtgctgg agcaggtgga gagggctat   1440
aggatgccct gcccacagga ctgcccgatc tccctgcacg agctcatgat ccactgctgg   1500
aaaaaggatc cggaagagcg cccgaccttc gagtacttgc agggcttcct ggaggactac   1560
tttacggcca cagagcccca gtatcagccc ggtgaaaaacc tgtga                  1605
```

SEQ ID NO: 212 Mouse FYN proto-oncogene amino acid sequence,
isoform a (NP_001116365.1)

```
MGCVQCKDKE AAKLTEERDG SLNQSSGYRY GIDPIPQHYP SEGVISIPNY NNFHAAGGQG    60
LIVEGGVNSS SHIGILRIRG GIGVILEVAL YDYEARTEDD LSFHKGEKFQ ILNSSEGDWW   120
EARSLITGET GYIPSNYVAP VDSIQAEEWY FGKLGRKDAE RQLLSFGNPR GIFLIRESET  180
TKGAYSLSIR DWDDMKGDHV KHYKIRKLDN GGYYITTRAQ FETLQQLVQH YSERAAGLCC  240
RLVVPCHKGM PRLIDLSVKI KDVWEIPRES LQLIKRLGNG QFGEVWMGTW NGNIKVAIKT  300
LKPGIMSPES FLEEAQIMKK LKHDKLVQLY AVVSEEPIYI VITYMSKGSL LDFLKDGEGR  360
ALKLPNLVDM AAQVAAGMAY IERMNYIHRD LRSANILVGN GLICKIADFG LARLIEDNEY  420
TARQGAKFPI KWIAPEAALY GRFTIKSDVW SEGILLTELV TKGRVPYPGM NNREVLEQVE  480
RGYRMPCPQD CPISLHELMI HCWKKDPEER PIFEYLQGFL EDYFTATEPQ YQPGENL     537
```

SEQ ID NO: 213 Mouse FYN proto-oncogene amino acid sequence,
isoform b (NP_001116364.1)

```
MGCVQCKDKE AAKLTEERDG SLNQSSGYRY GIDPIPQHYP SEGVISIPNY NNFHAAGGQG    60
LIVEGGVNSS SHIGILRIRG GIGVILEVAL YDYEARTEDD LSFHKGEKFQ ILNSSEGDWW   120
EARSLITGET GYIPSNYVAP VDSIQAEEWY FGKLGRKDAE RQLLSFGNPR GIFLIRESET  180
TKGAYSLSIR DWDDMKGDHV KHYKIRKLDN GGYYITTRAQ FETLQQLVQH YSEKADGLCF  240
NLIVSSSCT PQTSGLAKDA WEVARDSLFL EKKLGQGCFA EVWLGTWNGN TKVAIKILKP   300
GIMSPESFLE EAQIMKKLKH DKLVQLYAVV SEEPIYIVIE YMSKGSLLDF LKDGEGRALK  360
LPNLVDMAAQ VAAGMAYIER MNYIHRDLRS ANILVGNGLI CKIADFGLAR LIEDNEYTAR  420
QGAKFPIKWT APEAALYGRF TIKSDVWSFG ILLTELVIKG RVPYPGMNNR EVLEQVERGY  480
RMPCPQDCPI SLHELMIHCW KKDPEERPTF EYLQGFLEDY FTATEPQYQP GENL        534
```

SEQ ID NO: 214 Mouse FYN proto-oncogene amino acid sequence,
isoform b (NP_032080.2)

```
MGCVQCKDKE AAKLTEERDG SLNQSSGYRY GIDPIPQHYP SEGVISIPNY NNFHAAGGQG    60
LIVEGGVNSS SHIGILRIRG GIGVILEVAL YDYEARTEDD LSFHKGEKFQ ILNSSEGDWW   120
EARSLITGET GYIPSNYVAP VDSIQAEEWY FGKLGRKDAE RQLLSFGNPR GIFLIRESET  180
TKGAYSLSIR DWDDMKGDHV KHYKIRKLDN GGYYITTRAQ FETLQQLVQH YSEKADGLCF  240
NLIVSSSCT PQTSGLAKDA WEVARDSLFL EKKLGQGCFA EVWLGTWNGN TKVAIKILKP   300
GIMSPESFLE EAQIMKKLKH DKLVQLYAVV SEEPIYIVIE YMSKGSLLDF LKDGEGRALK  360
LPNLVDMAAQ VAAGMAYIER MNYIHRDLRS ANILVGNGLI CKIADFGLAR LIEDNEYTAR  420
QGAKFPIKWT APEAALYGRF TIKSDVWSFG ILLTELVIKG RVPYPGMNNR EVLEQVERGY  480
RMPCPQDCPI SLHELMIHCW KKDPEERPTF EYLQGFLEDY FTATEPQYQP GENL        534
```

SEQ ID NO: 215 House LCK proto-oncogene cDNA, transcript variant 1
(NM_001042771.2)

```
atgggctgtg gctgcagctc acacccggaa gatgactgga tggaaaacat cgatgtgtgt    60
gagaactgcc attatcccat agtccactg gatggcaagg gcacgctgct catccgaaat   120
ggctctgagg tgcgggaccc actggttacc tacgaaggct ccaatccgcc ggcttcccca  180
```

TABLE 2-continued

```
ctgcaagaca acctggttat cgctctgcac agctatgagc cctctcacga cggagatctg    240
ggctttgaga aggggggaaca gctccgcatc ctggagcaga gcggcgagtg gtggaaggcg    300
cagtccctga ccacgggcca ggaaggcttc atccccttca attttgtggc caaagcgaac    360
agcctggagc ccgaaccctg gttcttcaag aacctgagcc gcaaggacgc ggagcggcag    420
ctcctggcgc ccgggaacac tcacggctcc ttcctcatcc gggagagcga gagcaccgcg    480
ggatcgtttt cactgtcggt ccgggacttc gaccagaacc agggagaggt ggtgaaacat    540
tacaagatcc gtaatctgga caacggtggc ttctacatct cccctcgaat cacttttccc    600
ggcctgcatg aactggtccg ccattacacc aatgcttcag atgggctgtg cacacgttg     660
agccgcccct gccagaccca gaagcccag aagccgtggt gggaggacga gtgggaggtt     720
cccagggaga cgctgaagct ggtgagcgg ctgggggctg dacagttcgg ggaggtgtgg     780
atggggtact acaacgggca cacgaaggtg gcggtgaaga gcctgaagca gggcagcatg    840
tccccggacg ccttcctggc cgaggccaac ctcatgaagc agctgcaaca ccagcggctg    900
gttcggctct acgctgtggt cacccaggag cccatctaca tcatcactga atacatggag    960
aatgggagtc tagtggattt tctcaagacc ccttcaggca tcaagttgac catcaacaaa   1020
ctcctggaca tggcagccca aattgcagaa ggcatggcat tcattgaaga gcggaattat   1080
attcatcgtg accttcgggc tgccaacatt ctggtgtctg acaccctgag ctgcaagatt   1140
gcagactttg gcctagcacg cctcattgag gacaacgagt acacagccag ggaggggggcc   1200
aagtttccca ttaagtggac agcgccagaa gccattaact acgggacatt caccatcaag   1260
tcagatgtgt ggtctttttgg gatcctgctg acggaaattg tcacccacgg ccgcatccct   1320
tacccaggga tgaccaaccc ggaggtgatt cagaacctgg agcgaggcta ccgcatggtg   1380
cgccctgaca actgtccaga ggagctgtac caactcatga ggctgtgctg gaaggagcgc   1440
ccagaggacc ggcccacctt tgactacctg cgcagtgtgc tggaggactt cttcacggcc   1500
acagagggcc agtaccagcc tcagccttga                                    1530
```

SEQ ID NO: 216 House LCK proto-oncogene cDNA, transcript variant 2
(NM_005356.4)

```
atgggctgtg gctgcagctc acacccggaa gatgactgga tggaaaacat cgatgtgtgt    60
gagaactgcc attatcccat agtcccactg gatggcaagg gcacgctgct catccgaaat   120
ggctctgagg tgcgggaccc actggttacc tacgaaggct ccaatccgcc ggcttcccca   180
ctgcaagaca acctggttat cgctctgcac agctatgagc cctctcacga cggagatctg   240
ggctttgaga aggggggaaca gctccgcatc ctggagcaga gcggcgagtg gtggaaggcg   300
cagtccctga ccacgggcca ggaaggcttc atccccttca attttgtggc caaagcgaac   360
agcctggagc ccgaaccctg gttcttcaag aacctgagcc gcaaggacgc ggagcggcag   420
ctcctggcgc ccgggaacac tcacggctcc ttcctcatcc gggagagcga gagcaccgcg   480
ggatcgtttt cactgtcggt ccgggacttc gaccagaacc agggagaggt ggtgaaacat   540
tacaagatcc gtaatctgga caacggtggc ttctacatct cccctcgaat cacttttccc   600
ggcctgcatg aactggtccg ccattacacc aatgcttcag atgggctgtg cacacgttg    660
agccgcccct gccagaccca gaagcccag aagccgtggt gggaggacga gtgggaggtt    720
cccagggaga cgctgaagct ggtgagcgg ctgggggctg gacagttcgg ggaggtgtgg    780
atggggtact acaacgggca cacgaaggtg gcggtgaaga gcctgaagca gggcagcatg   840
tccccggacg ccttcctggc cgaggccaac ctcatgaagc agctgcaaca ccagcggctg   900
gttcggctct acgctgtggt cacccaggag cccatctaca tcatcactga atacatggag   960
aatgggagtc tagtggattt tctcaagacc ccttcaggca tcaagttgac catcaacaaa  1020
ctcctggaca tggcagccca aattgcagaa ggcatggcat tcattgaaga gcggaattat  1080
attcatcgtg accttcgggc tgccaacatt ctggtgtctg acaccctgag ctgcaagatt  1140
gcagactttg gcctagcacg cctcattgag gacaacgagt acacagccag ggaggggggcc  1200
aagtttccca ttaagtggac agcgccagaa gccattaact acgggacatt caccatcaag  1260
tcagatgtgt ggtctttttgg gatcctgctg acggaaattg tcacccacgg ccgcatccct  1320
tacccaggga tgaccaaccc ggaggtgatt cagaacctgg agcgaggcta ccgcatggtg  1380
cgccctgaca actgtccaga ggagctgtac caactcatga ggctgtgctg gaaggagcgc  1440
ccagaggacc ggcccacctt tgactacctg cgcagtgtgc tggaggactt cttcacggcc  1500
acagagggcc agtaccagcc tcagccttga                                   1530
```

SEQ ID NO: 217 House LCK proto-oncogene amino acid sequence
(NP_005347.3)

```
MGCGCSSHPE DDWMENIDVC ENCHYPIVPL DGKGILLIRN GSEVRDPLVT YEGSNPPASP    60
LQDNLVIALH SYEPSHDGDL GFEKGEQLRI LEQSGEWWKA QSLITGQEGF IFFNEVAKAN   120
SLEPEPWFFK NLSRKDAERQ LLAPGNTHGS FLIRESESTA GSFSLSVRDF DQNQGEVVKH   180
YKIRNLDNGG FYISPRITFP GLHELVRHYT NASDGLCIRL SRPCQTQKPQ KPWWEDEWEV   240
PREILKLVER LGAGQFGEVW MGYYNGHTKV AVKSLKQGSM SPDAFLAEAN LMKQLQHQRL   300
VRLYAVVIQE PIYIITEYME NGSLVDFLKT PSGIKLTINK LLDMAAQIAE GMAFIEERNY   360
IHRDLRAANI LVSDILSCKI ADFGLARLIE DNEYTAREGA KFPIKWIAPE AINYGIFTIK   420
SDVWSFGILL TEIVHGRIP YPGMINPEVI QNLERGYRMV RPDNCPEELY QLMRLCWKER   480
PEDRPTEDYL RSVLEDFFIA TEGQYQPQP                                    509
```

SEQ ID NO: 218 House LCK proto-oncogene amino acid sequence
(NP_001036236.1)

```
MGCGCSSHPE DDWMENIDVC ENCHYPIVPL DGKGILLIRN GSEVRDPLVT YEGSNPPASP    60
LQDNLVIALH SYEPSHDGDL GFEKGEQLRI LEQSGEWWKA QSLITGQEGF IFFNEVAKAN   120
SLEPEPWFFK NLSRKDAERQ LLAPGNTHGS FLIRESESTA GSFSLSVRDF DQNQGEVVKH   180
YKIRNLDNGG FYISPRITFP GLHELVRHYT NASDGLCIRL SRPCQTQKPQ KPWWEDEWEV   240
PREILKLVER LGAGQFGEVW MGYYNGHTKV AVKSLKQGSM SPDAFLAEAN LMKQLQHQRL   300
VRLYAVVIQE PIYIITEYME NGSLVDFLKT PSGIKLTINK LLDMAAQIAE GMAFIEERNY   360
IHRDLRAANI LVSDILSCKI ADFGLARLIE DNEYTAREGA KFPIKWIAPE AINYGIFTIK   420
SDVWSFGILL TEIVHGRIP YPGMINPEVI QNLERGYRMV RPDNCPEELY QLMRLCWKER   480
PEDRPTEDYL RSVLEDFFIA TEGQYQPQP                                    509
```

TABLE 2-continued

SEQ ID NO: 219 Mouse LCK proto-oncogene cDNA, transcript variant 1
(NM_001162432.1)

```
atggggcct ctgagctgac gatctcgggg atcatgggct gtgtctgcag ctcaaaccct    60
gaagatgact ggatggagaa cattgacgtg tgtgaaaact gccactatcc catagtccca   120
ctggacagca agatctcgct gcccatccgg aatggctctg aagtgcggga cccactggtc   180
acctatgagg gatctctccc accagcatcc ccgctgcaag acaacctggt tatcgccctg   240
cacagttatg agccctccca tgatggagac ttgggctttg agaagggtga acagctccga   300
atccctggagc agagcggtga gtggtggaag gctcagtccc tgacgactgg ccaagaaggc   360
ttcattccct tcaacttcgt ggcgaaagca aacagcctgg agcctgaacc ttggttcttc   420
aagaatctga gccgtaagga cgccgagcgg cagcttttgg cgcccgggaa cacgcatgga   480
tccttcctga tccgggaaag cgaaagcact gcggggtcct tttccctgtc ggtcagagac   540
ttcgaccaga accagggaga agtggtgaaa cattacaaga tccgtaacct agacaacggt   600
ggcttctaca tctcccctcg tatcactttt cccggattgc acgatctagt ccgccattac   660
accaacgcct tgatgggct gtgcacaaag ttgagccgtc cttgccagac ccagaagccc   720
cagaaaccat ggtgggagga cgaatgggaa gttcccaggg aaacactgaa gttggtggag   780
cggctgggag ctggccagtt cggggaagtg tggatgggct actacaacgg acacacgaag   840
gtggcggtga agagtctgaa acaagggagc atgtcccccg acgccttcct ggctgaggct   900
aacctcatga gcagctgca gcacccgcgg ctagtccggc tttatgcagt ggtcaccccag   960
gaacccatct acatcatcac ggaatacatg gagaacggga gccatagtaga ttttctcaag  1020
actccctcgg gcatcaagtt gaatgtcaac aaacttttgg acatgctcac cagattgca   1080
gagggcatgg cgttcatcga agaacagaat tacatccatc gggacctgcg cgccgccaac  1140
atcctggtgt ctgacacgct gagctgcaag attgcagact ttggcctggc gcgcctcatt  1200
gaggacaatg agtacacggc ccgggagggg gccaaatttc ccattaagtg gacagccacca  1260
gaagccatta actatgggac cttcaccatc aagtcagagc tgtggtcctt cgggatctg   1320
cttacagaga tcgtcaccca cggtcgaatc ccttacccag gaatgaccaa ccctgaagtc  1380
attcagaacc tggagagagg ctaccgcatg gtgagacctg acaactgtcc ggaagagctg  1440
taccacctca tgatgctgtg ctggaaggag cgcccagagg accggcccac gtttgactac  1500
cttcggagtg ttctggatga cttcttcaca gccacagagg ccagtacca gccccagcct  1560
tga                                                                1563
```

SEQ ID NO: 220 Mouse LCK proto-oncogene cDNA, transcript variant 2
(NM_010693.3)

```
atgggctgtg tctgcagctc aaaccctgaa gatgactgga tggagaacat tgacgtgtgt    60
gaaaactgcc actatcccat agtcccactg gacagcaaga tctcgctgcc catccggaat   120
ggctctgaag tgcggacccc actggtcacc tatgagggat ctctcccacc agcatccccg   180
ctgcaagaca acctggttat cgccctgcac agttatgagc cctcccatga tggagacttg   240
ggctttgaga agggtgaaca gctccgaatc ctggagcaga gcggtgagtg gtggaaggct   300
cagtccctga cgactggcca agaaggcttc attcccttca acttcgtggc gaaagcaaac   360
agcctggagc ctgaaccttg gttcttcaag aatctgagcc gtaaggacgc cgagcggcag   420
cttttggcgc ccgggaacac gcatggatcc ttcctgatcc gggaaagcga aagcactgcg   480
gggtcctttt ccctgtcggt cagagacttc gaccagaacc agggagaagt ggtgaaacat   540
tacaagatcc gtaacctaga caacggtggc ttctacatct cccctcgtat cacttttccc   600
ggattgcacg atctagtccg ccattacacc aacgcctctg atgggctgtg cacaaagttg   660
agccgtcctt gccagaccca gaagcccag aaaccatggt gggaggacga atggaagtt   720
cccagggaaa cactgaagtt ggtgagcgg ctgggagctg gccagttcgg ggaagtgtgg   780
atggggtact acaacggaca cacgaaggtg gcggtgaaga gtctgaaaca agggagcatg   840
tccccgacg ccttcctggc tgaggctaac ctcatgaagc agctgcagca cccgcggcta   900
gtccggcttt atgcagtggt cacccaggaa cccatctaca tcatcacgga atacatggag   960
aacgggagcc tagtagattt tctcaagact ccctcgggca tcaagttgaa tgtcaacaaa  1020
cttttggaca tggcagccca gattgcagag gcatggcgt tcatcgaaga acagaattac  1080
atccatcggg acctgcgcgc cgccaacatc tggtgtctg acacgctgag ctgcaagatt  1140
gcagacttg gcctggcgcg cctcattgag gacaatgagt acacggcccg ggaggggcc  1200
aaatttccca ttaagtggac agccaccaa atgggaccctt caccatcaag  1260
tcagacgtgt ggtccttcgg gatcttgctt acagagatcg tcacccacgg tcgaatccct  1320
tacccaggaa tgaccaaccc tgaagtcatt cagaacctgg agagaggcta ccgcatggtg  1380
agacctgaca actgtccgga agagctgtac cacctcatga tgctgtgctg gaaggagcgc  1440
ccagaggacc ggcccacgtt tgactacctt cggagtgttc tggatgactt cttcacagcc  1500
acagagggcc agtaccagcc ccagccttga                                    1530
```

SEQ ID NO: 221 Mouse LCK proto-oncogene cDNA, transcript variant 3
(NM_001162433.1)

```
atgggctgtg tctgcagctc aaaccctgaa gatgactgga tggagaacat tgacgtgtgt    60
gaaaactgcc actatcccat agtcccactg gacagcaaga tctcgctgcc catccggaat   120
ggctctgaag tgcggacccc actggtcacc tatgagggat ctctcccacc agcatccccg   180
ctgcaagaca acctggttat cgccctgcac agttatgagc cctcccatga tggagacttg   240
ggctttgaga agggtgaaca gctccgaatc ctggagcaga gcggtgagtg gtggaaggct   300
cagtccctga cgactggcca agaaggcttc attcccttca acttcgtggc gaaagcaaac   360
agcctggagc ctgaaccttg gttcttcaag aatctgagcc gtaaggacgc cgagcggcag   420
cttttggcgc ccgggaacac gcatggatcc ttcctgatcc gggaaagcga aagcactgcg   480
gggtcctttt ccctgtcggt cagagacttc gaccagaacc agggagaagt ggtgaaacat   540
tacaagatcc gtaacctaga caacggtggc ttctacatct cccctcgtat cacttttccc   600
ggattgcacg atctagtccg ccattacacc aacgcctctg atgggctgtg cacaaagttg   660
agccgtcctt gccagaccca gaagcccag aaaccatggt gggaggacga atggaagtt   720
cccagggaaa cactgaagtt ggtgagcgg ctgggagctg gccagttcgg ggaagtgtgg   780
atggggtact acaacggaca cacgaaggtg gcggtgaaga gtctgaaaca agggagcatg   840
tccccgacg ccttcctggc tgaggctaac ctcatgaagc agctgcagca cccgcggcta   900
gtccggcttt atgcagtggt cacccaggaa cccatctaca tcatcacgga atacatggag   960
```

TABLE 2-continued

```
aacgggagcc tagtagattt tctcaagact ccctcgggca tcaagttgaa tgtcaacaaa   1020
cttttggaca tggcagccca gattgcagag ggcatggcgt tcatcgaaga acagaattac   1080
atccatcggg acctgcgcgc cgccaacatc ctggtgtctg acacgctgag ctgcaagatt   1140
gcagactttg gcctggcgcg cctcattgag gacaatgagt acacggcccg ggaggggggcc   1200
aaatttccca ttaagtggac agcaccagaa gccattaact atgggacctt caccatcaag   1260
tcagacgtgt ggtccttcgg gatcttgctt acagagatcg tcacccacgg tcgaatccct   1320
tacccaggaa tgaccaaccc tgaagtcatt cagaacctgg agagaggcta ccgcatggtg   1380
agacctgaca actgtccgga agagctgtac cacctcatga tgctgtgctg gaaggagcgc   1440
ccagaggacc ggcccacgtt tgactacctt cggagtgttc tggatgactt cttcacagcc   1500
acagagggcc agtaccagcc ccagccttga                                    1530
```

SEQ ID NO: 222 Mouse LCK proto-oncogene amino acid sequence,
isoform a (NP_001155904.1)

```
MGASELTISG IMGCVCSSNP EDDWMENIDV CENCHYPIVP LDSKISLPIR NGSEVRDPLV    60
TYEGSLPPAS PLQDNLVIAL HSYEPSHDGD LGFEKGEQLR ILEQSGEWWK AQSLITGQEG   120
FIPFNFVAKA NSLEPEPWFF KNLSRKDAER QLLAPGNITI SFLIRESEST AGSFSLSVRD   180
FDQNQGEVVK HYKIRNLDNG GFYISPRITF PGLHDLVRHY INASDGLCIK LSRPCQTQKP   240
QKPWWEDEWE VPREILKLVE RLGAGQFGEV WMGYYNGHTK VAVKSLKQGS MSPDAFLAEA   300
NLMKQLQHPR LVRLYAVVIQ EPIYIITEYM ENGSLVDFLK TPSGIKLNVN KLLDMAAQIA   360
EGMAFIEEQN YIHRDLRAAN ILVSDILSCK IADFGLARLI EDNEYTAREG AKFPIKWIAP   420
EAINYGIFTI KSDVWSFGIL LTEIVIHGRI PYPGMINPEV IQNLERGYRM VRPDNCPEEL   480
YHLMMLCWKE RPEDRPTEDY LRSVLDDFFT ATEGQYQPQP                         520
```

SEQ ID NO: 223 Mouse LCK proto-oncogene amino acid sequence,
isoform b (NP_001155905.1)

```
MGCVCSSNPE DDWMENIDVC ENCHYPIVPL DSKISLPIRN GSEVRDPLVT YEGSLPPASP    60
LQDNLVIALH SYEPSHDGDL GFEKGEQLRI LEQSGEWWKA QSLITGQEGF IPFNFVAKAN   120
SLEPEPWFFK NLSRKDAERQ LLAPGNTHGS FLIRESESTA GSFSLSVRDF DQNQGEVVKH   180
YKIRNLDNGG FYISPRITFP GLHDLVRHYT NASDGLCIKL SRPCQTQKPQ KPWWEDEWEV   240
PREILKLVER LGAGQFGEVW MGYYNGHTKV AVKSLKQGSM SPDAFLAEAN LMKQLQHPRL   300
VRLYAVVIQE PIYIITEYME NGSLVDFLKT PSGIKLNVNK LLDMAAQIAE GMAFIEEQNY   360
IHRDLRAANI LVSDILSCKI ADFGLARLIE DNEYTAREGA KFPIKWIAPE AINYGIFTIK   420
SDVWSFGILL TEIVIHGRIP YPGMINPEVI QNLERGYRMV RPDNCPEELY HLMMLCWKER   480
PEDRPTEDYL RSVLDDFFIA TEGQYQPQP                                     509
```

SEQ ID NO: 224 Mouse LCK proto-oncogene amino acid sequence,
isoform b (NP_034823.1)

```
MGCVCSSNPE DDWMENIDVC ENCHYPIVPL DSKISLPIRN GSEVRDPLVT YEGSLPPASP    60
LQDNLVIALH SYEPSHDGDL GFEKGEQLRI LEQSGEWWKA QSLITGQEGF IPFNFVAKAN   120
SLEPEPWFFK NLSRKDAERQ LLAPGNITIG FLIRESESTA GSFSLSVRDF DQNQGEVVKH   180
YKIRNLDNGG FYISPRITFP GLHDLVRHYT NASDGLCIKL SRPCQTQKPQ KPWWEDEWEV   240
PREILKLVER LGAGQFGEVW MGYYNGHTKV AVKSLKQGSM SPDAFLAEAN LMKQLQHPRL   300
VRLYAVVIQE PIYIITEYME NGSLVDFLKT PSGIKLNVNK LLDMAAQIAE GMAFIEEQNY   360
IHRDLRAANI LVSDILSCKI ADFGLARLIE DNEYTAREGA KFPIKWIAPE AINYGIFTIK   420
SDVWSFGILL TEIVIHGRIP YPGMINPEVI QNLERGYRMV RPDNCPEELY HLMMLCWKER   480
PEDRPTEDYL RSVLDDFFIA TEGQYQPQP                                     509
```

SEQ ID NO: 225 Human Yes-1 proto-oncogene cDNA (NM_005433.3)

```
atgggctgca ttaaaagtaa agaaaacaaa agtccagcca ttaaatacag acctgaaaat     60
actccagagc ctgtcagtac aagtgtgagc cattatggag cagaacccac tacagtgtca    120
ccatgtccgt catcttcagc aaagggaaca gcagttaatt tcagcagtcc ttccatgaca    180
ccatttggag gatcctcagg ggtaacgcct tttggaggtg catcttcctc attttcagtg    240
gtgccaagtt catatcctgc tggtttaaca ggtggtgtta ctatatttgt ggccttatat    300
gattatgaag ctagaactac agaagacctt tcatttaaga gggtgaaag atttcaaata    360
attaacaata cggaaggaga ttggtgggaa gcaagatcaa tcgctacagg aaagaatggt    420
tatatcccga gcaattatgt agcgcctgca gattccattc aggcagaaga atggtatttt    480
ggcaaaatgg ggagaaaaga tgctgaaaga ttacttttga atcctggaaa tcaacgaggt    540
attttcttag taagagagag tgaaacaact aaaggtgctt attcccttct tattcgtgat    600
tgggatgaaa taagggggtga caatgtgaaa cactacaaaa ttaggaaact tgacaatggt    660
ggatactata tcacaaccag agcacaattt gatactctgc agaaattggt gaaacactac    720
acagaacatg ctgatggttt atgccacaag ttgacaactg tgtgtccaac tgtgaaacct    780
cagactcaag gtcagcaaa agatgcttgg gaatccctc gagaatcttt gcgactagag    840
gttaaactag gacaaggatg tttcggcgaa gtgtggatgg aacatggaa tggaaccagc    900
aaagtagcaa tcaaaacact aaaaccaggt acaatgatgc cagaagcttt ccttcaagaa    960
gctcagataa tgaaaaaatt aagacatgat aaacttgtcc actatatgc tgttgttttct   1020
gaagaaccaa tttacattgt cactgaattt atgtcaaaag aagcttatt agatttcctt   1080
aaggaaggta tggaaagta tttgaagctt ccacagctgg ttgatatggc tgctcagatt   1140
gctgatggta tggcatatat tgaaagaatg aactatattc accgagatct tcggcctgct   1200
aatattcttg taggagaaaa tcttgtgtgc aaaatagcag actttggttt agcaaggtta   1260
attgaagaca tgaatacac agcaagacaa ggtgcaaaat ttccaatcaa atggacagct   1320
cctgaagctg cactgtatgg tcggtttaca ataaagtcta atgtctggtc atttggaatt   1380
ctgcaaacag aactagtaac aaagggccga gtgccatatc caggtatggt gaaccgtgaa   1440
gtactagaac aagtggagcg aggatacagg atgccgtgcc tcagggctg tccagaatcc   1500
ctccatgaat tgatgaatct gtgttggaag aaggacctg atgaaagacc aacatttgaa   1560
tatattcagt cccttcttgga agactacttc actgctacag agccacagta ccagccagga   1620
gaaaatttat aa                                                       1632
```

TABLE 2-continued

SEQ ID NO: 226 Human Yes-1 proto-oncogene amino acid sequence
(NP_005424.1)

| | | | | | |
|---|---|---|---|---|---|
| MGCIKSKENK | SPAIKYRPEN | TPEPVSTSVS | HYGAEPTIVS | PCPSSSAKGT | AVNESSLSMT | 60
| PEGGSSGVIP | FGGASSSFSV | VPSSYPAGLI | GGVTIEVALY | DYEARTTEDL | SFKKGERFQI | 120
| INNTEGDWWE | ARSIAIGKNG | YIPSNYVAPA | DSIQAEEWYF | GKMGRKDAER | LLLNPGNQRG | 180
| IFLVRESETT | KGAYSLSIRD | WDEIRGDNVK | HYKIRKLDNG | GYYITTRAQF | DILQKLVKHY | 240
| TEHADGLCHK | LITVCPTVKP | QTQGLAKDAW | EIPRESLRLE | VKLGQGCFGE | VWMGIWNGTT | 300
| KVAIKILKPG | IMMPEAFLQE | AQIMKKLRHD | KLVPLYAVVS | EEPIYIVIEF | MSKGSLLDFL | 360
| KEGDGKYLKL | PQLVDMAAQI | ADGMAYIERM | NYIHRDLRAA | NILVGENLVC | KIADFGLARL | 420
| IEDNEYTARQ | GAKFPIKWIA | PEAALYGRFT | IKSDVWSFGI | LQTELVIKGR | VPYPGMVNRE | 480
| VLEQVERGYR | MPCPQGCPES | LHELMNLCWK | KDPDERPTFE | YIQSFLEDYF | TATEPQYQPG | 540
| ENL | | | | | | 543

SEQ ID NO: 227 Mouse Yes-1 proto-oncogene cDNA, transcript variant
1 (NM_009535.3)

| | | | | | |
|---|---|---|---|---|---|
| atgggctgca | ttaaaagtaa | agaaaacaaa | agtccagcca | taaaatacac | accggaaaat | 60
| cttacagagc | ctgtaagccc | aagtgccagt | cattatggag | tggaacatgc | tacagttgcc | 120
| ccgacctctt | ccacaaaggg | agcatcagtt | aattttaaca | gtctttccat | gacacccttt | 180
| ggagggtcct | caggggtgac | tccttttgga | ggagcgtctt | cctcattctc | agtggtgtca | 240
| agttcatatc | ctacaggttt | aacaggtggt | gtcactatat | ttgtggcctt | gtatgattat | 300
| gaagctagaa | ctacagaaga | cctttccttt | aagaagggtg | aacgatttca | aataattaac | 360
| aatacggaag | gagactggtg | ggaagcaaga | tcaattgcta | ccggaaagag | tggttatatc | 420
| cctagcaatt | acgtagtgcc | tgcagattcc | attcaggcag | aagaatggta | ttttggcaaa | 480
| atggggagaa | aagatgcgga | aagattactt | ctgaatcctg | ggaatcagcg | aggtattttc | 540
| ttagtaagag | aaagtgaaac | tactaaaggt | gcttactccc | tctcaatccg | tgattgggat | 600
| gaggtgaggg | gtgacaatgt | gaagcattac | aagatcagaa | aacttgacaa | tggtggctac | 660
| tacatcacga | ccagagctca | gtttgataca | ctgcagaagc | tggtgaagca | ctacacagaa | 720
| catgctgatg | gattatgcca | caagttaaca | actgtgtgtc | ctactgtgaa | acccagact | 780
| caaggtctgg | caaagatgc | ttgggaaatc | cctcgagaat | cattgcgact | agaggtgaaa | 840
| ctaggtcaag | gatgctttgg | ggaagtgtgg | atgggaacat | ggaatggaac | tacaaaagta | 900
| gcaatcaaaa | cactaaagcc | aggtacaatg | atgccagaag | cattccttca | agaagctcag | 960
| ataatgaaaa | agctaagaca | cgataaactt | gttccactct | atgcagttgt | ttctgaagag | 1020
| cccatttata | ttgtcaccga | gtttatgtca | aaaggaagct | tgttagattt | ccttaaagaa | 1080
| ggagatggaa | agtatttgaa | gcttccacag | ctggttgata | tggctgctca | gatcgctgat | 1140
| ggcatggcgt | atattgaaag | aatgaactat | attcaccgag | atctccgagc | tgctaatatt | 1200
| cttgtaggag | aaaatcttat | atgcaaaata | gcagattttg | gcttagcaag | attaattgaa | 1260
| gacaatgaat | acacggcaag | acaaggtgca | aaatttccaa | tcaagtggac | agctcctgag | 1320
| gctgctctgt | atggtcgatt | tacaataaag | tcagatgtgt | ggtcatttgg | aattctacag | 1380
| acagagctgg | taacaaaagg | aagagtgcca | tatccaggta | tggtaaaccg | tgaagtattg | 1440
| gaacaagtag | agcggggata | cagaatgcct | tgccccagg | gctgtcccga | atccctccat | 1500
| gaattgatga | atctttgctg | gaagaaggat | cctgatgaaa | gaccaacatt | tgaatatatt | 1560
| cagtccttct | tggaagacta | cttcactgct | acagagccac | agtaccaacc | aggagaaaat | 1620
| ttataa | | | | | | 1626

SEQ ID NO: 228 Mouse Yes-1 proto-oncogene cDNA, transcript variant
2 (NM_001205132.1)

| | | | | | |
|---|---|---|---|---|---|
| atgggctgca | ttaaaagtaa | agaaaacaaa | agtccagcca | taaaatacac | accggaaaat | 60
| cttacagagc | ctgtaagccc | aagtgccagt | cattatggag | tggaacatgc | tacagttgcc | 120
| ccgacctctt | ccacaaaggg | agcatcagtt | aattttaaca | gtctttccat | gacacccttt | 180
| ggagggtcct | caggggtgac | tccttttgga | ggagcgtctt | cctcattctc | agtggtgtca | 240
| agttcatatc | ctacaggttt | aacaggtggt | gtcactatat | ttgtggcctt | gtatgattat | 300
| gaagctagaa | ctacagaaga | cctttccttt | aagaagggtg | aacgatttca | aataattaac | 360
| aatacggaag | gagactggtg | ggaagcaaga | tcaattgcta | ccggaaagag | tggttatatc | 420
| cctagcaatt | acgtagtgcc | tgcagattcc | attcaggcag | aagaatggta | ttttggcaaa | 480
| atggggagaa | aagatgcgga | aagattactt | ctgaatcctg | ggaatcagcg | aggtattttc | 540
| ttagtaagag | aaagtgaaac | tactaaaggt | gcttactccc | tctcaatccg | tgattgggat | 600
| gaggtgaggg | gtgacaatgt | gaagcattac | aagatcagaa | aacttgacaa | tggtggctac | 660
| tacatcacga | ccagagctca | gtttgataca | ctgcagaagc | tggtgaagca | ctacacagaa | 720
| catgctgatg | gattatgcca | caagttaaca | actgtgtgtc | ctactgtgaa | acccagact | 780
| caaggtctgg | caaagatgc | ttgggaaatc | cctcgagaat | cattgcgact | agaggtgaaa | 840
| ctaggtcaag | gatgctttgg | ggaagtgtgg | atgggaacat | ggaatggaac | tacaaaagta | 900
| gcaatcaaaa | cactaaagcc | aggtacaatg | atgccagaag | cattccttca | agaagctcag | 960
| ataatgaaaa | agctaagaca | cgataaactt | gttccactct | atgcagttgt | ttctgaagag | 1020
| cccatttata | ttgtcaccga | gtttatgtca | aaaggaagct | tgttagattt | ccttaaagaa | 1080
| ggagatggaa | agtatttgaa | gcttccacag | ctggttgata | tggctgctca | gatcgctgat | 1140
| ggcatggcgt | atattgaaag | aatgaactat | attcaccgag | atctccgagc | tgctaatatt | 1200
| cttgtaggag | aaaatcttat | atgcaaaata | gcagattttg | gcttagcaag | attaattgaa | 1260
| gacaatgaat | acacggcaag | acaaggtgca | aaatttccaa | tcaagtggac | agctcctgag | 1320
| gctgctctgt | atggtcgatt | tacaataaag | tcagatgtgt | ggtcatttgg | aattctacag | 1380
| acagagctgg | taacaaaagg | aagagtgcca | tatccaggta | tggtaaaccg | tgaagtattg | 1440
| gaacaagtag | agcggggata | cagaatgcct | tgccccagg | gctgtcccga | atccctccat | 1500
| gaattgatga | atctttgctg | gaagaaggat | cctgatgaaa | gaccaacatt | tgaatatatt | 1560
| cagtccttct | tggaagacta | cttcactgct | acagagccac | agtaccaacc | aggagaaaat | 1620
| ttataa | | | | | | 1626

TABLE 2-continued

SEQ ID NO: 229 Mouse Yes-1 proto-oncogene cDNA, transcript variant
1 (NM_001205133.1)

```
atgggctgca ttaaaagtaa agaaaacaaa agtccagcca taaaatacac accggaaaat    60
cttacagagc ctgtaagccc aagtgccagt cattatggag tggaacatgc tacagttgcc   120
ccgacctctt ccacaaaggg agcatcagtt aattttaaca gtctttccat gacaccctt    180
ggagggtcct caggggtgac tcctttggga ggagcgtctt cctcattctc agtggtgtca   240
agttcatatc ctacaggttt aacaggtggt gtcactatat ttgtggcctt gtatgattat   300
gaagctagaa ctacagaaga ccttttcctt aagaagggtg aacgatttca ataattaac    360
aatacggaag gagactggtg ggaagcaaga tcaattgcta ccggaaagag tggttatatc   420
cctagcaatt acgtagtgcc tgcagattcc attcaggcag aagaatggta ttttggcaaa   480
atggggagaa agatgcgga aagattactt ctgaatcctg ggaatcagcg aggtatttc   540
ttagtaagag aaagtgaaac tactaaaggt gcttactccc tctcaatccg tgattgggat   600
gaggtgaggg gtgacaatgt gaagcattac aagatcagaa aacttgacaa tggtggctac   660
tacatcacga ccagagctca gtttgataca ctgcagaagc tggtgaagca ctacacagaa   720
catgctgatg gattatgcca caagttaaca actgtgtgtc ctactgtgaa accccagact   780
caaggtctgg caaaagatgc ttgggaaatc cctcgagaat cattgcgact agaggtgaaa   840
ctaggtcaag gatgctttgg ggaagtgtgg atgggaacat ggaatggaac tacaaaagta   900
gcaatcaaaa cactaaagcc aggtacaatg atgccagaag cattccttca agaagctcag   960
ataatgaaaa agctaagaca cgataaactt gttccactct atgcagttgt ttctgaagag  1020
cccatttata ttgtcaccga gtttatgtca aaaggaagct tgttagattt ccttaaagaa  1080
ggagatggaa agtatttgaa gcttccacag ctggttgata tggctgctca gatcgctgat  1140
ggcatggcgt atattgaaag aatgaactat attcaccgag atctccgagc tgctaatatt  1200
cttgtaggag aaaatcttat atgcaaaata gcagattttg gcttagcaga attaattgaa  1260
gacaatgaat acacggcaag acaaggtgca aaatttccaa tcaagtggac agctcctgag  1320
gctgctctgt atggtcgatt tacaataaag tcagatgtgt ggtcatttgg aattctacag  1380
acagagctgg taacaaaagg aagagtgcca tatccaggta tggtaaaccg tgaagtattg  1440
gaacaagtag agcggggata cagaatgcct tgccccccag gctgtcccga atccctccat  1500
gaattgatga atctttgctg gaagaaggat cctgatgaaa gaccaacatt tgaatatatt  1560
cagtccttct tggaagacta cttcactgct acagagccac agtaccaacc aggagaaaat  1620
ttataa                                                              1626
```

SEQ ID NO: 230 Mouse Yes-1 proto-oncogene amino acid sequence
(NP_033561.1)

```
MGCIKSKENK SPAIKYTPEN LTEPVSPSAS HYGVEHATVA PISSITGASV NENSLSMTPF    60
GGSSGVIPFG GASSSFSVVS SSYPTGLIGG VTIEVALYDY EARTTEDLSF KKGERFQIIN   120
NTEGDWWEAR SIAIGKSGYI PSNYVVPADS IQAEEWYFGK MGRKDAERLL LNPGNQRGIF   180
LVRESETTKG AYSLSIRDWD EVRGDNVKHY KIRKLDNGGY YITTRAQFDT LQKLVKHYTE   240
HADGLCHKLI TVCPTVKPQT QGLAKDAWEI PRESLRLEVK LGQGCFGEVW MGIWNGTIKV   300
AIKILKPGIM MPEAFLQEAQ IMKKLRHDKL VPLYAVVSEE PIYIVIEFMS KGSLLDFLKE   360
GDGKYLKLPQ LVDMAAQIAD GMAYIERMNY IHRDLRAANI LVGENLICKI ADFGLARLIE   420
DNEYTARQGA KFPIKWIAPE AALYGRFTIK SDVWSFGILQ TELVIKGRVP YPGMVNREVL   480
EQVERGYRMP CPQGCPESLH ELMNLCWKKD PDERPTFEYI QSFLEDYFTA TEPQYQPGEN   540
L                                                                    541
```

SEQ ID NO: 231 Mouse Yes-1 proto-oncogene amino acid sequence
(NP_001192061.1)

```
mgclkskenk spalkytpen ltepvspsas hygvehatva ptsstkgasv nfnslsmtpf    60
ggssgvtpfg gasssfsvvs ssyptgltgg vtifvalydy earttedlsf kkgerfqiin   120
ntegdwwear siatgksgyi psnyvvpads lqaeewyfgk mgrkdaerll lnpgnqrgif   180
lvresettkg ayslsirdwd evrgdnvkhy kirkldnggy yittraqfdt lqklvkhyte   240
hadglchklt tvcptvkpqt qglakdawel preslrlevk lgqgcfgevw mgtwngttkv   300
alktlkpgtm mpeaflqeaq imkklrhdkl vplyavvsee plylvtefms kgslldflke   360
gdgkylklpq lvdmaaqiad gmayiermny ihrdlraani lvgenlicki adfglarlie   420
dneytarqga kfpikwtape aalygrftik sdvwsfgilq telvtkgrvp ypgmvnrevl   480
eqvergyrmp cpqgcpeslh elmnlcwkkd pderptfeyi qsfledyfta tepqyqpgen   540
l                                                                    541
```

SEQ ID NO: 232 Mouse Yes-1 proto-oncogene amino acid sequence
(NP_001192062.1)

```
MGCIKSKENK SPAIKYTPEN LTEPVSPSAS HYGVEHATVA PISSITGASV NENSLSMTPF    60
GGSSGVIPFG GASSSFSVVS SSYPTGLIGG VTIEVALYDY EARTTEDLSF KKGERFQIIN   120
NTEGDWWEAR SIAIGKSGYI PSNYVVPADS IQAEEWYFGK MGRKDAERLL LNPGNQRGIF   180
LVRESETTKG AYSLSIRDWD EVRGDNVKHY KIRKLDNGGY YITTRAQFDT LQKLVKHYTE   240
HADGLCHKLI TVCPTVKPQT QGLAKDAWEI PRESLRLEVK LGQGCFGEVW MGIWNGTIKV   300
AIKILKPGIM MPEAFLQEAQ IMKKLRHDKL VPLYAVVSEE PIYIVIEFMS KGSLLDFLKE   360
GDGKYLKLPQ LVDMAAQIAD GMAYIERMNY IHRDLRAANI LVGENLICKI ADFGLARLIE   420
DNEYTARQGA KFPIKWIAPE AALYGRFTIK SDVWSFGILQ TELVIKGRVP YPGMVNREVL   480
EQVERGYRMP CPQGCPESLH ELMNLCWKKD PDERPTFEYI QSFLEDYFTA TEPQYQPGEN   540
L                                                                    541
```

SEQ ID NO: 233 Human LYN proto-oncogene cDNA, transcript variant 1
(NM_002350.3)

```
atgggatgta aaaatcaaa agggaaagac agcttgagtg acgatggagt agatttgaag   60
actcaaccag tacgtaatac tgaaagaact atttatgtga gagatccaac gtccaataaa  120
```

TABLE 2-continued

```
cagcaaaggc cagttccaga atctcagctt ttacctggac agaggtttca aactaaagat    180
ccagaggaac aaggagacat tgtggtagcc ttgtacccct atgatggcat ccacccggac    240
gacttgtctt tcaagaaagg agagaagatg aaagtcctgg aggagcatgg agaatggtgg    300
aaagcaaagt ccctttaac aaaaaaagaa ggcttcatcc ccagcaacta tgtggccaaa     360
ctcaacacct tagaaacaga agagtggttt tcaaggata taaccaggaa ggacgcagaa    420
aggcagcttt tggcaccagg aaatagcgct ggagctttcc ttattagaga aagtgaaaca    480
ttaaaaggaa gcttctctct gtctgtcaga gactttgacc ctgtgcatgg tgatgttatt    540
aagcactaca aaattagaag tctggataat ggggctatt acatctctcc acgaatcact     600
tttccctgta tcagcgacat gattaaacat taccaaaagc aggcagatgg cttgtgcaga    660
agattggaga aggcttgtat tagtcccaag ccacagaagc catgggataa agatgcctgg    720
gagatccccc gggagtccat caagttggtg aaaaggcttg gcgctgggca gtttggggaa    780
gtctggatgg gttactataa caacagtacc aaggtggctg tgaaaccct gaagccagga     840
actatgtctg tgcaagcctt cctggaagaa gccaacctca tgaagacct gcagcatgac     900
aagctcgtga ggctctacgc tgtggtcacc agggaggagc ccatttacat catcaccgag    960
tacatggcca agggcagttt gctggatttc ctgaagagcg atgaaggtgg caaagtgctg   1020
cttccaaagc tcattgactt ttctgctcag attgcagagg aatggcata catcgagcgg    1080
aagaactaca ttcaccggga cctgcgagca gctaatgttc tggtctccga gtcactcatg   1140
tgcaaaattg cagattttgg ccttgctaga gtaattgaag ataatgagta cacagcaagg   1200
gaaggtgcta agttccctat taagtggacg gctccagaag caatcaactt ggatgtttc    1260
actattaagt ctgatgtgtg gtcctttgga atcctcctat acgaaattgt cacctatggg   1320
aaaattccct acccagggag aactaatgcc gacgtgatga ccgcctgc ccagggctac     1380
aggatgcccc gtgtggagaa ctgcccagat gagctctatg acattatgaa aatgtgctga   1440
aaagaaaagg cagaagagag accaacgttt gactacttac agagcgtcct ggatgatttc   1500
tacacagcca cggaagggca ataccagcag cagcccttag                          1539
```

SEQ ID NO: 234 Human LYN proto-oncogene cDNA, transcript variant 2
(NM_001111097.2)

```
atgggatgta taaatcaaa agggaaagac agcttgagtg acgatggagt agatttgaag     60
actcaaccag ttccagaatc tcagctttta cctggacaga ggtttcaaac taaagatcca    120
gaggaacaag gagacattgt ggtagccttg taccccctatg atggcatcca cccgacgac   180
ttgtctttca agaaggaga agatgaaa gtcctgagg agcatggaga atggtggaaa       240
gcaaagtccc ttttaacaaa aaagaaggc ttcatcccca gcaactatgt ggccaaactc    300
aacaccttag aaacagaaga gtggtttttc aaggatataa ccaggaaggac cagaaagg    360
cagcttttgg caccaggaaa tagcgctgga gctttcctta ttagagaaag tgaaacatta    420
aaaggaagct ctctctgtc tgtcagagac tttgaccctg tgcatggtga tgttattaag    480
cactacaaaa ttagaagtct ggataatggg gctattaca tctctccacg aatcactttt     540
ccctgtatca gcgacatgat taaacattac caaaagcagg ctgatggctt gtgcagaaga    600
ttggagaagg cttgtattag tcccaagcca cagaagccat gggataaaga tgcctgggag    660
atcccccggg agtccatcaa gttggtgaaa aggcttggcg ctgggcagtt tggggaagtc    720
tggatgggtt actataacaa cagtaccaag gtggctgtga aaaccctgaa gccaggaact    780
atgtctgtgc aagccttcct ggaagaagcc aacctcatga agaccctgca gcatgacaag    840
ctcgtgaggc tctacgctgt ggtcaccagg gaggagccca tttacatcat caccgagtac    900
atggccaagg gcagtttgct ggatttcctg aagagcgatg aaggtggcaa agtgctgctt    960
ccaaagctca ttgactttc tgctcagatt gcagaggaa tggcatacat cgagcggaag    1020
aactacattc accgggacct gcgagcagct aatgttctgg tctccgagtc actcatgtgc   1080
aaaattgcag attttggcct tgctagagta attgaagata atgagtacac agcaagggaa   1140
ggtgctaagt tccctattaa gtggacggct ccagaagcaa tcaactttgg atgtttcact   1200
attaagtctg atgtgtggtc ctttggaatc ctcctatacg aaattgtcac ctatgggaaa   1260
attccctacc cagggagaac taatgccgac gtgatgaccg ccctgtccca gggctacagg   1320
atgccccgtg tggagaactg cccagatgag ctctatgaca ttatgaaaat gtgctgaaa   1380
gaaaaggcag aagagaccc aacgtttgac tacttacaga gcgtcctgga tgatttctac   1440
acagccacgg aagggcaata ccagcagcag ccttag                              1476
```

SEQ ID NO: 235 Human LYN proto-oncogene amino acid sequence,
isoform a (NP_002341.1)

```
MGCIKSKGKD SLSDDGVDLK TQPVRNTERT IYVRDPISNK QQRPVPESQL LPGQRFQTKD     60
PEEQGDIVVA LYPYDGIHPD DLSFKKGEKM KVLEEHGEWW KAKSLLIKKE GFIPSNYVAK    120
LNTLETEEWF FKDITRKDAE RQLLAPGNSA GAFLIRESET LKGSFSLSVR DFDPVHGDVI    180
KHYKIRSLDN GGYYISPRIT FPCISDMIKH YQKQADGLCR RLEKACISPK PQKPWDKDAW    240
EIPRESIKLV KRLGAGQFGE VWMGYYNNST KVAVKILKPG IMSVQAFLEE ANLMKTLQHD    300
KLVRLYAVVI REEPIYIITE YMAKGSLLDF LKSDEGGKVL PKLIDFSAQ IAEGMAYIER    360
KNYIHRDLRA ANVLVSESLM CKIADFGLAR VIEDNEYTAR EGAKFPIKWT APEAINFGCF    420
TIKSDVWSFG ILLYEIVTYG KIPYPGRINA DVMTALSQGY RMPRVENCPD ELYDIMKMCW    480
KEKAEERPTF DYLQSVLDDF YTATEGQYQQ QP                                   512
```

SEQ ID NO: 236 Human LYN proto-oncogene amino acid sequence,
isoform b (NP_001104567.1)

```
MGCIKSKGKD SLSDDGVDLK TQPVPESQLL PGQRFQTKDP EEQGDIVVAL YPYDGIHPDD     60
LSFKKGEKMK VLEEHGEWWK AKSLLIKKEG FIPSNYVAKL NTLETEEWFF KDITRKDAER    120
QLLAPGNSAG AFLIRESEIL KGSFSLSVRD FDPVHGDVIK HYKIRSLDNG GYYISPRITF    180
PCISDMIKHY QKQADGLCRR LEKACISPKP QKPWDKDAWE IPRESIKLVK RLGAGQFGEV    240
WMGYYNNSTK VAVKILKPGT MSVQAFLEEA NLMKTLQHDK LVRLYAVVIR EEPIYIITEY    300
MAKGSLLDFL KSDEGGKVLL PKLIDFSAQI AEGMAYIERK NYIHRDLRAA NVLVSESLMC    360
KIADFGLARV IEDNEYTARE GAKFPIKWIA PEAINFGCFT IKSDVWSFGI LLYEIVTYGK    420
IPYPGRINAD VMTALSQGYR MPRVENCPDE LYDIMKMCWK EKAEERPTED YLQSVLDDFY    480
TATEGQYQQQ P                                                         491
```

TABLE 2-continued

SEQ ID NO: 237 Mouse LYN proto-oncogene cDNA, transcript variant 1
(NM_001111096.1)

```
atgggatgta ttaaatcaaa aaggaaagac aatctcaatg acgatgaagt agattcgaag    60
actcaaccag tacgtaatac tgaccgaact atttatgtga gagatccaac gtccaataaa   120
cagcaaaggc cagttcctga atttcatctt ttaccaggac agagatttca aacaaaagat   180
ccagaggaac aaggtgacat tgtggtggcc ttataccctt atgatggcat ccacccagat   240
gacttgtcct tcaagaaagg agaaaagatg aaagttctag aagagcatgg ggaatggtgg   300
aaagctaagt cccttctcatc aaagagagaa ggcttcatcc ccagcaacta cgtggccaag   360
gtcaacacct tagaaactga agagtggttc ttcaaggaca taacaaggaa agatgcagag   420
cgacagcttc tggcaccagg aacagtgcag ggagctttcc ttatcagaga aagcgaaact   480
ttaaagggaa gcttctctct ttctgtcaga gattatgacc ctatgcatgg tgatgtcatt   540
aagcactaca aaattagaag tctggacaat ggtggctatt acatctctcc tcgcatcact   600
tttccctgca tcagtgacat gattaagcat taccaaaagc agtctgatgg tctatgcaga   660
agactggaga aggcatgcat cagtcccaaa cctcagaagc catgggataa agatgcctgg   720
gagatccccc gggagtccat taagttggtg aaaaagcttg gcgcagggca gtttggggaa   780
gtctggatgg gttactataa caacagcaca aaggtgctg tgaagaccct caagcccggc   840
accatgtctg tgcaggcatt cctggaagag gccaacctca tgaagacctt gcaacatgac   900
aagctagtgc ggctgtacgc tgtggtcacc aaggaggagc ccatctacat catcaccgag   960
ttcatggcta agggtagttt gctggatttc ctcaagagtg atgaaggtgg caaggtgctg  1020
ctgcccaagc tcattgactt ctcggcccag attgcagaag gcatggcgta catcgagcgg  1080
aagaactaca tccaccgtga tctgcgagct gctaacgtcc tggtctctga gtcactcatg  1140
tgcaagattg cagactttgg cctcgcgaga gtcatcgaag ataacgagta cacagcaagg  1200
gaaggtgcga agttccctat caagtggaca gctccagagg ccatcaactt cggctgcttc  1260
actatcaaat ctgacgtgtg gtccttcgga attcctgtg atgagattgt cacctatggg  1320
aagattccct acccagggag aaccaacgca gatgtgatga gcgcactgtc acagggatat  1380
cgaatgccac gcatggagaa ctgcccagat gagctctatg acatcatgaa aatgtgttgg  1440
aaagaaaagg cagaggagag gccaactttt gactacttac agagtgtcct ggatgacttc  1500
tatacagcca cagaagggca gtatcagcag caaccgtag                          1539
```

SEQ ID NO: 238 Mouse LYN proto-oncogene cDNA, transcript variant 2
(NM_010747.2)

```
atgggatgta ttaaatcaaa aaggaaagac aatctcaatg acgatgaagt agattcgaag    60
actcaaccag ttcctgaatt tcatctttta ccaggacaga gatttcaaac aaaagatcca   120
gaggaacaag gtgacattgt ggtggcctta taccctatg atggcatcca cccagatgac   180
ttgtccttca gaaaggagaa aagatgaaa gttctagaag agcatgggga atggtggaaa   240
gctaagtccc tttcatcaaa gagagaaggc ttcatccca gcaactacgt ggccaaggtc   300
aacaccttag aaactgaaga gtggttcttc aaggacataa caaggaaaga tgcagagcga   360
cagcttctgg caccagggaa cagtgcagga gctttcctta tcagaaaag cgaaacttta   420
aagggaagct ctctctttc tgtcagagat tatgacccta tgcatggtga tgtcattaag   480
cactacaaaa ttagaagtct ggacaatggt ggctattaca tctctcctcg catcactttt   540
ccctgcatca gtgacatgat taagcattac caaaagcagt ctgatggtct atgcagaaga   600
ctggagaagg catgcatcag tcccaaacct cagaagccat gggataaaga tgcctgggag   660
atccccgga gtccattaa gttggtgaaa aagcttggcg cagggcagtt tggggaagtc   720
tggatgggtt actataacaa cagcacaaag gtgctgtga gaccctcaag cccggcacc   780
atgtctgtgc aggcattcct ggaagaggcc aacctcatga gaccttgca acatgacaag   840
ctagtgcggc tgtacgctgt ggtcaccaag gaggagccca tctacatcat caccgagttc   900
atggctaagg gtagtttgct ggatttcctc aagagtgatg aaggtggcaa ggtgctgctg   960
cccaagctca ttgacttctc ggcccagatt gcagaaggca tggcgtacat cgagcggaag  1020
aactacatcc accgtgatct gcgagctgct aacgtcctgg tctctgagtc actcatgtgc  1080
aagattgcag actttggcct cgcgagagtc atcgaagata acgagtacac agcaagggaa  1140
ggtgcgaagt tccctatcaa gtggacagct ccagaggcca tcaacttcgg ctgcttcact  1200
atcaaatctg acgtgtggtc cttcggaatt cctgtatg attgtcacct atgggaag     1260
attccctacc cagggagaac caacgcagat gtgatgagcg cactgtcaca gggatatcga  1320
atgccacgca tggagaactg cccagatgag ctctatgaca tcatgaaaat gtgttggaaa  1380
gaaaaggcag aggagaggcc aacttttgac tacttacaga gtgtcctgga tgacttctat  1440
acagccacag aagggcagta tcagcagcaa ccgtag                            1476
```

SEQ ID NO: 239 Mouse LYN proto-oncogene amino acid sequence,
isoform a (NP_001104566.1)

```
MGCIKSKRKD NLNDDEVDSK TQPVRNTDRT IYVRDPISNK QQRPVPEFHL LPGQRFQTKD    60
PEEQGDIVVA LYPYDGIHPD DLSFKKGEKM KVLEEHGEWW KAKSLSSKRE GFIPSNYVAK   120
VNTLETEEWF FKDITRKDAE RQLLAPGNSA GAFLIRESET LKGSFSLSVR DYDPMHGDVI   180
KHYKIRSLDN GGYYISPRIT FPCISDMIKH YQKQSDGLCR RLEKACISPK PQKPWDKDAW   240
EIPRESIKLV KKLGAGQF48GE VWMGYYNNST KVAVKILKPG IMSVQAFLEE ANLMKTLQHD   300
KLVRLYAVVT KEEPIYIITE FMAKGSLLDF LKSDEGGKVL LPKLIDFSAQ IAEGMAYIER   360
KNYIHRDLRA ANVLVSESLM CKIADFGLAR VIEDNEYTAR EGAKFPIKWT APEAINFGCF   420
TIKSDVWSFG ILLYEIVTYG KIPYPGRINA DVMSALSQGY RMPRMENCPD ELYDIMKMCW   480
KEKAEERPTF DYLQSVLDDF YTATEGQYQQ QP                                 512
```

SEQ ID NO: 240 Mouse LYN proto-oncogene amino acid sequence,
isoform b (NP_034877.2)

```
MGCIKSKRKD NLNDDEVDSK TQPVPEFHLL PGQRFQTKDP EEQGDIVVAL YPYDGIHPDD    60
LSFKKGEKMK VLEEHGEWWK AKSLSSKREG FIPSNYVAKV NTLETEEWFF KDITRKDAER   120
QLLAPGNSAG AFLIRESEIL KGSFSLSVRD YDPMHGDVIK HYKIRSLDNG GYYISPRITF   180
PCISDMIKHY QKQSDGLCRR LEKACISPKP QKPWDKDAWE IPRESIKLVK KLGAGQFGEV   240
WMGYYNNSTK VAVKILKPGT MSVQAFLEEA NLMKTLQHDK LVRLYAVVIK EEPIYIITEF   300
```

TABLE 2-continued

```
MAKGSLLDFL KSDEGGKVLL PKLIDFSAQI AEGMAYIERK NYIHRDLRAA NVLVSESLMC    360
KIADFGLARV IEDNEYTARE GAKFPIKWIA PEAINFGCFT IKSDVWSFGI LLYEIVTYGK    420
IPYPGRINAD VMSALSQGYR MPRMENCPDE LYDIMKMCWK EKAEERPTED YLQSVLDDFY    480
TATEGQYQQQ P                                                        491
```

SEQ ID NO: 241 Human FGR proto-oncogene cDNA, transcript variant 1
(NM_005248.2)

```
atgggctgtg tgttctgcaa gaaattggag ccggtggcca cggccaagga ggatgctggc     60
ctggaagggg acttcagaag ctacggggca gcagaccact atgggcctga ccccactaag    120
gcccggcctg catcctcatt tgcccacatc cccaactaca gcaacttctc ctctcaggcc    180
atcaaccctg gcttccttga tagtggcacc atcaggggtg tgtcagggat tggggtgacc    240
ctgttcattg ccctgtatga ctatgaggct cgaactgagg atgacctcac cttcaccaag    300
ggcgagaagt tccacatcct gaacaatact gaaggtgact ggtgggaggc tcggtctctc    360
agctccggaa aaactggctg cattcccagc aactacgtgg ccctgttga ctcaatccaa     420
gctgaagagt ggtactttgg aaagattggg agaaaggatg cagagaggca gctgctttca    480
ccaggcaacc cccaggggc cttttctcatt cgggaaagcg agaccaccaa aggtgcctac    540
tccctgtcca tccgggactg ggatcagacc agaggcgatc atgtgaagca ttacaagatc    600
cgcaaactgg acatgggcgg ctactacatc accacacggg ttcagttcaa ctcggtgcag    660
gagctggtgc agcactacat ggaggtgaat gacgggctgt gcaacctgct catcgcgccc    720
tgcaccatca tgaagccgca gacgctgggc ctggccaagg acgcctggga gatcagccgc    780
agctccatca cgctggagcg ccggctgggc accggctgct cggggatgt gtggctgggc    840
acgtggaacg gcagcactaa ggtggcggtg aagacgctga agccgggcac catgtccccg    900
aaggccttcc tggaggaggc gcaggtcatg aagctgctgc ggcacgacaa gctggtgcag    960
ctgtacgccg tggtgtcgga ggagcccatc tacatcgtga ccgagttcat gtgtcacggc   1020
agcttgctgg attttctcaa gaacccagag ggccaggatt tgaggctgcc ccaattggtg   1080
gacatggcag cccaggtagc tgagggcatg gcctacatgg aacgcatgaa ctacattcac   1140
cgcgacctga gggcagccaa catcctggtt ggggagcggc tggcgtgcaa gatcgcagac   1200
tttggcttgg cgcgtctcat caaggacgat gagtacaacc cctgccaagg ttccaagttc   1260
cccatcaagt ggacagcccc agaagctgcc ctctttggca gattcaccat caagtcagac   1320
gtgtggtcct ttgggatcct gctcactgag ctcatcacca agggccgaat ccctaccca    1380
ggcatgaata acgggaagt gttggaacag gtggagcagg gctaccacat gccgtgccct   1440
ccaggctgcc cagcatccct gtacgaggcc atgaacaga cctggcgtct ggacccggag    1500
gagaggccta ccttcgagta cctgcagtcc ttcctggagg actacttcac ctccgctgaa   1560
ccacagtacc agcccgggga tcagacatag                                   1590
```

SEQ ID NO: 242 Human FGR proto-oncogene cDNA, transcript variant 2
(NM_001042747.1)

```
atgggctgtg tgttctgcaa gaaattggag ccggtggcca cggccaagga ggatgctggc     60
ctggaagggg acttcagaag ctacggggca gcagaccact atgggcctga ccccactaag    120
gcccggcctg catcctcatt tgcccacatc cccaactaca gcaacttctc ctctcaggcc    180
atcaaccctg gcttccttga tagtggcacc atcaggggtg tgtcagggat tggggtgacc    240
ctgttcattg ccctgtatga ctatgaggct cgaactgagg atgacctcac cttcaccaag    300
ggcgagaagt tccacatcct gaacaatact gaaggtgact ggtgggaggc tcggtctctc    360
agctccggaa aaactggctg cattcccagc aactacgtgg ccctgttga ctcaatccaa     420
gctgaagagt ggtactttgg aaagattggg agaaaggatg cagagaggca gctgctttca    480
ccaggcaacc cccaggggc cttttctcatt cgggaaagcg agaccaccaa aggtgcctac    540
tccctgtcca tccgggactg ggatcagacc agaggcgatc atgtgaagca ttacaagatc    600
cgcaaactgg acatgggcgg ctactacatc accacacggg ttcagttcaa ctcggtgcag    660
gagctggtgc agcactacat ggaggtgaat gacgggctgt gcaacctgct catcgcgccc    720
tgcaccatca tgaagccgca gacgctgggc ctggccaagg acgcctggga gatcagccgc    780
agctccatca cgctggagcg ccggctgggc accggctgct cggggatgt gtggctgggc    840
acgtggaacg gcagcactaa ggtggcggtg aagacgctga agccgggcac catgtccccg    900
aaggccttcc tggaggaggc gcaggtcatg aagctgctgc ggcacgacaa gctggtgcag    960
ctgtacgccg tggtgtcgga ggagcccatc tacatcgtga ccgagttcat gtgtcacggc   1020
agcttgctgg attttctcaa gaacccagag ggccaggatt tgaggctgcc ccaattggtg   1080
gacatggcag cccaggtagc tgagggcatg gcctacatgg aacgcatgaa ctacattcac   1140
cgcgacctga gggcagccaa catcctggtt ggggagcggc tggcgtgcaa gatcgcagac   1200
tttggcttgg cgcgtctcat caaggacgat gagtacaacc cctgccaagg ttccaagttc   1260
cccatcaagt ggacagcccc agaagctgcc ctctttggca gattcaccat caagtcagac   1320
gtgtggtcct ttgggatcct gctcactgag ctcatcacca agggccgaat ccctaccca    1380
ggcatgaata acgggaagt gttggaacag gtggagcagg gctaccacat gccgtgccct   1440
ccaggctgcc cagcatccct gtacgaggcc atgaacaga cctggcgtct ggacccggag    1500
gagaggccta ccttcgagta cctgcagtcc ttcctggagg actacttcac ctccgctgaa   1560
ccacagtacc agcccgggga tcagacatag                                   1590
```

SEQ ID NO: 243 Human FGR proto-oncogene cDNA, transcript variant 3
(NM_001042729.1)

```
atgggctgtg tgttctgcaa gaaattggag ccggtggcca cggccaagga ggatgctggc     60
ctggaagggg acttcagaag ctacggggca gcagaccact atgggcctga ccccactaag    120
gcccggcctg catcctcatt tgcccacatc cccaactaca gcaacttctc ctctcaggcc    180
atcaaccctg gcttccttga tagtggcacc atcaggggtg tgtcagggat tggggtgacc    240
ctgttcattg ccctgtatga ctatgaggct cgaactgagg atgacctcac cttcaccaag    300
ggcgagaagt tccacatcct gaacaatact gaaggtgact ggtgggaggc tcggtctctc    360
agctccggaa aaactggctg cattcccagc aactacgtgg ccctgttga ctcaatccaa     420
gctgaagagt ggtactttgg aaagattggg agaaaggatg cagagaggca gctgctttca    480
ccaggcaacc cccaggggc cttttctcatt cgggaaagcg agaccaccaa aggtgcctac    540
tccctgtcca tccgggactg ggatcagacc agaggcgatc atgtgaagca ttacaagatc    600
```

TABLE 2-continued

```
cgcaaactgg acatgggcgg ctactacatc accacacggg ttcagttcaa ctcggtgcag   660
gagctggtgc agcactacat ggaggtgaat gacgggctgt gcaacctgct catcgcgccc   720
tgcaccatca tgaagccgca gacgctgggc ctggccaagg acgcctggga gatcagccgc   780
agctccatca cgctggagcg ccggctgggc accggctgct tcggggatgt gtggctgggc   840
acgtggaacg gcagcactaa ggtggcggtg aagacgctga agcgggcac catgtccccg    900
aaggccttcc tggaggaggc gcaggtcatg aagctgctgc ggcacgacaa gctggtgcag   960
ctgtacgccg tggtgtcgga ggagcccatc tacatcgtga ccgagttcat gtgtcacggc  1020
agcttgctgg attttctcaa gaacccagag ggccaggatt gaggctgcc ccaattggtg   1080
gacatggcag cccaggtagc tgagggcatg cctacatgg aacgcatgaa ctacattcac   1140
cgcgacctga gggcagccaa catcctggtt ggggagcggc tggcgtgcaa gatcgcagac  1200
tttggcttgg cgcgtctcat caaggacgat gagtacaacc cctgccaagg ttccaagttc  1260
cccatcaagt ggacagcccc agaagctgcc ctctttggca gattcaccat caagtcagac  1320
gtgtggtcct ttgggatcct gctcactgag ctcatcacca agggccgaat ccctacccca  1380
ggcatgaata aacgggaagt gttggaacag gtggagcagg gctaccacat gccgtgccct  1440
ccaggctgcc cagcatccct gtacgaggcc atggaacaga cctggcgtct ggacccggag  1500
gagaggccta ccttcgagta cctgcagtcc ttcctggagg actacttcac ctccgctgaa  1560
ccacagtacc agcccgggga tcagacatag                                   1590
```

SEQ ID NO: 244 Human FGR proto-oncogene amino acid sequence
(NP_005239.1)

```
MGCVFCKKLE PVATAKEDAG LEGDFRSYGA ADHYGPDPIK ARPASSFAHI PNYSNFSSQA   60
INPGFLDSGT IRGVSGIGVT LFIALYDYEA RTEDDLIFIK GEKFHILNNT EGDWWEARSL  120
SSGKIGCIPS NYVAPVDSIQ AEEWYFGKIG RKDAERQLLS PGNPQGAFLI RESETTKGAY  180
SLSIRDWDQT RGDHVKHYKI RKLDMGGYYI TIRVQFNSVQ ELVQHYMEVN DGLCNLLIAP  240
CTIMKPQTLG LAKDAWEISR SSITLERRLG TGCFGDVWLG TWNGSTKVAV KILKPGIMSP  300
KAFLEEAQVM KLLRHDKLVQ LYAVVSEEPI YIVIEFMCHG SLLDFLKNPE GQDLRLPQLV  360
DMAAQVAEGM AYMERMNYIH RDLRAANILV GERLACKIAD FGLARLIKDD EYNPCQGSKF  420
PIKWIAPEAA LFGRFTIKSD VWSEGILLTE LITKGRIPYP GMNKREVLEQ VEQGYHMPCP  480
PGCPASLYEA MEQTWRLDPE ERPTFEYLQS FLEDYFTSAE PQYQPGDQT             529
```

SEQ ID NO: 245 Human FGR proto-oncogene amino acid sequence
(NP_001036194.1)

```
MGCVFCKKLE PVATAKEDAG LEGDFRSYGA ADHYGPDPIK ARPASSFAHI PNYSNFSSQA   60
INPGFLDSGT IRGVSGIGVT LFIALYDYEA RTEDDLIFIK GEKFHILNNT EGDWWEARSL  120
SSGKIGCIPS NYVAPVDSIQ AEEWYFGKIG RKDAERQLLS PGNPQGAFLI RESETTKGAY  180
SLSIRDWDQT RGDHVKHYKI RKLDMGGYYI TIRVQFNSVQ ELVQHYMEVN DGLCNLLIAP  240
CTIMKPQTLG LAKDAWEISR SSITLERRLG TGCFGDVWLG TWNGSTKVAV KILKPGIMSP  300
KAFLEEAQVM KLLRHDKLVQ LYAVVSEEPI YIVIEFMCHG SLLDFLKNPE GQDLRLPQLV  360
DMAAQVAEGM AYMERMNYIH RDLRAANILV GERLACKIAD FGLARLIKDD EYNPCQGSKF  420
PIKWIAPEAA LFGRFTIKSD VWSEGILLTE LITKGRIPYP GMNKREVLEQ VEQGYHMPCP  480
PGCPASLYEA MEQTWRLDPE ERPTFEYLQS FLEDYFTSAE PQYQPGDQT             529
```

SEQ ID NO: 246 Human FGR proto-oncogene amino acid sequence
(NP_001036212.1)

```
MGCVFCKKLE PVATAKEDAG LEGDFRSYGA ADHYGPDPIK ARPASSFAHI PNYSNFSSQA   60
INPGFLDSGT IRGVSGIGVT LFIALYDYEA RTEDDLIFIK GEKFHILNNT EGDWWEARSL  120
SSGKIGCIPS NYVAPVDSIQ AEEWYFGKIG RKDAERQLLS PGNPQGAFLI RESETTKGAY  180
SLSIRDWDQT RGDHVKHYKI RKLDMGGYYI TIRVQFNSVQ ELVQHYMEVN DGLCNLLIAP  240
CTIMKPQTLG LAKDAWEISR SSITLERRLG TGCFGDVWLG TWNGSTKVAV KILKPGIMSP  300
KAFLEEAQVM KLLRHDKLVQ LYAVVSEEPI YIVIEFMCHG SLLDFLKNPE GQDLRLPQLV  360
DMAAQVAEGM AYMERMNYIH RDLRAANILV GERLACKIAD FGLARLIKDD EYNPCQGSKF  420
PIKWIAPEAA LFGRFTIKSD VWSEGILLTE LITKGRIPYP GMNKREVLEQ VEQGYHMPCP  480
PGCPASLYEA MEQTWRLDPE ERPTFEYLQS FLEDYFTSAE PQYQPGDQT             529
```

SEQ ID NO: 247 Mouse FGR proto-oncogene cDNA (NM_010208.4)

```
atgggctgtg tgttctgcaa gaagttggag cctgcatcca aggaggatgt gggcctggaa    60
ggggacttcc ggagccaaac ggctgaagaa cgctatttcc ctgacccac tcaaggacgg    120
acttcgtccg tctttcctca gcccaccagc cctgctttcc tcaacactgg caacatggca   180
agcatctcag ggaccggagt gaccatattc gtcgccctgt acgactatga ggccaggaca   240
ggggatgacc tcaccttcac caaaggcgag aagttccaca tcctgaacaa tacggagtat   300
gactggtggg aggctcgctc cctgagctcc ggacacagag gctatgttcc cagcaactat   360
gttgctcctg tggattccat ccaggctgaa gagtggtact tcgggaaagat cagtagaaag   420
gatgcagaga ggcagcttct gtcctctggt aaccccccagg gggccttctt cattcgggaa   480
agcgagacca ccaaagggc ctactccctg tccatccgtg actgggacca gaacagaggc   540
gatcacataa agcattataa gatccgaaag ctggacacgg cggctacta catcaccaca   600
cgggcccagt ttgactccat acaggaccta gtgcggcaat acatggaagt gaatgatggt   660
ctgtgctact tgcttacggc gccttgtacc accactaagc cccagactgt aggcctggcc   720
aaggatgcct gggagatcga ccggaactcc atagcactgg aacgcaggct gggcaccggc   780
tgctttggag atgtgtggct gggcacatgg aactgcagca caaggtggc agtgaagacg   840
ctgaagccgg gcaccatgtc cccgaaggca ttcctgagga agcacagat caagtcggg   900
ctgaggcacg acaagctggt gcagctgtat gcgtggtgt cggaggaacc catttatatt   960
gtgacagagt tcatgtgcta tggtagcttt ctggattcc taaaggatcg agaaggtcag  1020
aacttgatgc tgccccatct agtggacatg gctgcccagg tagccgaggg catggcctac  1080
atggaacgca tgaactatat ccaccgagac ttgagggcag ccaacatcct ggtgggggaa  1140
tacctaatat gcaagatcgc tgacttcggg ctggcacgcc tcatagagga caatgagtat  1200
```

TABLE 2-continued

```
aaccccccaac aaggaaccaa gttccccatc aagtggacag ccccagaggc cgccctcttt    1260
ggcagattca ctgtcaaatc agacgtgtgg tcctttggga ttctgctcac tgaactgatc    1320
accaagggca gagttcccta cccaggtatg aacaaccggg aagtgttgga acaggtggag    1380
catggctacc acatgccgtg ccctccagga tgtcctgcat ccctgtatga ggtcatggag    1440
caggcgtggc gcctggatcc agaggagagg cccacctttg agtacctgca gtctttcctg    1500
gaagactatt tcacctccac agaaccacag taccagcctg gagaccagac atag           1554
```

SEQ ID NO: 248 Mouse FGR proto-oncogene amino acid sequence
                                (NP_034338.3)

```
MGCVFCKKLE PASKEDVGLE GDERSQTAEE RYFPDPIQGR ISSVFPQPIS PAELNIGNMR     60
SISGIGVTIF VALYDYEART GDDLIFIKGE KFHILNNTEY DWWEARSLSS GHRGYVPSNY    120
VAPVDSIQAE EWYFGKISRK DAERQLLSSG NPQGAFLIRE SETTKGAYSL SIRDWDQNRG    180
DHIKHYKIRK LDIGGYYITT RAQFDSIQDL VRHYMEVNDG LCYLLTAPCT ITKPQTLGLA    240
KDAWEIDRNS IALERRLGIG CFGDVWLGTW NCSTKVAVKI LKPGIMSPKA FLEEAQIMKL    300
LRHDKLVQLY AVVSEEPIYI VIEFMCYGSL LDFLKDREGQ NLMLPHLVDM AAQVAEGMAY    360
MERMNYIHRD LRAANILVGE YLICKIADFG LARLIEDNEY NPQQGTKEPI KWIAPEAALF    420
GRFTVKSDVW SEGILLTELI TKGRVPYPGM NNREVLEQVE HGYHMPCPPG CPASLYEVME    480
QAWRLDPEER PIFEYLQSFL EDYFTSTEPQ YQPGDQT                             517
```

SEQ ID NO: 249 Human HCK proto-oncogene cDNA, transcript variant 1
                                (NM_002110.3)

```
atggggtgca tgaagtccaa gttcctccag gtcggaggca atacattctc aaaaactgaa      60
accagcgcca gcccacactg tcctgtgtac gtgccggatc ccacatccac catcaagccg     120
gggcctaata gccacaacag caacacacca ggaatcaggg aggcaggctc tgaggacatc     180
atcgtggttg ccctgtatga ttacgaggcc attcaccacg aagacctcag cttccagaag     240
ggggaccaga tggtggtcct agaggaatcc ggggagtggt ggaaggctcg atccctggcc     300
acccggaagg agggctacat cccaagcaac tatgtcgccc gcgttgactc tctgagaca     360
gaggagtggt tttcaaggg catcagccgg aaggacgcag agcgccaact gctggctccc     420
ggcaacatgc tgggctcctt catgatccgg gatagcgaga ccactaaagg aagctactct     480
ttgtccgtgc agactacga ccctcggcag ggagataccg tgaaacatta caagatccgg     540
accctggaca acgggggctt ctacatatcc ccccgaagca ccttcagcac tctgcaggag     600
ctggtggacc actacaagaa ggggaacgac gggctctgcc agaaactgtc ggtgccctgc     660
atgtcttcca gccccagaa gccttgggag aaagatgcct gggagatccc tcgggaatcc     720
ctcaagctgg agaagaaact tggagctggg cagtttgggg aagtctggat ggccacctac     780
aacaagcaca ccaaggtggc agtgaagacg atgaagccag ggagcatgtc ggtggaggcc     840
ttcctggcag aggccaacgt gatgaaaact ctgcagcatg acaagctggt caaacttcat     900
gcggtggtca ccaaggagcc catctacatc atcacggagt tcatggccaa aggaagcttg     960
ctggactttc tgaaaagtga tgagggcagc aagcagccat tgccaaaact cattgacttc    1020
tcagcccaga ttgcagaagg catggccttc atcgagcaga ggaactacat ccaccgagac    1080
ctccgagctg ccaacatctt ggtctctgca tccctggtgt gtaagattgc tgactttggc    1140
ctggcccggg tcattgagga caacgagtac acggctcggg aaggggccaa gttccccatc    1200
aagtggacag ctcctgaagc catcaacttt ggctccttca ccatcaagtc agacgtctgg    1260
tcctttggta tcctgctgat ggagatcgtc acctacggcc ggatccctta cccagggatg    1320
tcaaaccctg aagtgatccg agctctggag cgtggatacc ggatgcctcg cccagagaac    1380
tgcccagagg agctctacaa catcatgatg cgctgctgga aaaaccgtcc ggaggagcgg    1440
ccgaccttcg aatacatcca gagtgtgctg gatgacttct acacggccac agagagccag    1500
taccaacagc agccatga                                                  1518
```

SEQ ID NO: 250 Human HCK proto-oncogene cDNA, transcript variant 1
                                (NM_001172129.1)

```
atggggtgca tgaagtccaa gttcctccag gtcggaggca atacattctc aaaaactgaa      60
accagcgcca gcccacactg tcctgtgtac gtgccggatc ccacatccac catcaagccg     120
gggcctaata gccacaacag caacacacca ggaatcaggg aggcaggctc tgaggacatc     180
atcgtggttg ccctgtatga ttacgaggcc attcaccacg aagacctcag cttccagaag     240
ggggaccaga tggtggtcct agaggaatcc ggggagtggt ggaaggctcg atccctggcc     300
acccggaagg agggctacat cccaagcaac tatgtcgccc gcgttgactc tctgagaca     360
gaggagtggt tttcaaggg catcagccgg aaggacgcag agcgccaact gctggctccc     420
ggcaacatgc tgggctcctt catgatccgg gatagcgaga ccactaaagg aagctactct     480
ttgtccgtgc agactacga ccctcggcag ggagataccg tgaaacatta caagatccgg     540
accctggaca acgggggctt ctacatatcc ccccgaagca ccttcagcac tctgcaggag     600
ctggtggacc actacaagaa ggggaacgac gggctctgcc agaaactgtc ggtgccctgc     660
atgtcttcca gccccagaa gccttgggag aaagatgcct gggagatccc tcgggaatcc     720
ctcaagctgg agaagaaact tggagctggg cagtttgggg aagtctggat ggccacctac     780
aacaagcaca ccaaggtggc agtgaagacg atgaagccag ggagcatgtc ggtggaggcc     840
ttcctggcag aggccaacgt gatgaaaact ctgcagcatg acaagctggt caaacttcat     900
gcggtggtca ccaaggagcc catctacatc atcacggagt tcatggccaa aggaagcttg     960
ctggactttc tgaaaagtga tgagggcagc aagcagccat tgccaaaact cattgacttc    1020
tcagcccaga ttgcagaagg catggccttc atcgagcaga ggaactacat ccaccgagac    1080
ctccgagctg ccaacatctt ggtctctgca tccctggtgt gtaagattgc tgactttggc    1140
ctggcccggg tcattgagga caacgagtac acggctcggg aaggggccaa gttccccatc    1200
aagtggacag ctcctgaagc catcaacttt ggctccttca ccatcaagtc agacgtctgg    1260
tcctttggta tcctgctgat ggagatcgtc acctacggcc ggatccctta cccagggatg    1320
tcaaaccctg aagtgatccg agctctggag cgtggatacc ggatgcctcg cccagagaac    1380
tgcccagagg agctctacaa catcatgatg cgctgctgga aaaaccgtcc ggaggagcgg    1440
ccgaccttcg aatacatcca gagtgtgctg gatgacttct acacggccac agagagccag    1500
taccaacagc agccatga                                                  1518
```

TABLE 2-continued

SEQ ID NO: 251 Human HCK proto-oncogene cDNA, transcript variant 2 (NM_001172130.1)

```
atgggtgca tgaagtccaa gttcctccag gtcggaggca atacattctc aaaaactgaa      60
accagcgcca gcccacactg tcctgtgtac gtgccggatc ccacatccac catcaagccg    120
gggcctaata gccacaacag caacacacca ggaatcaggg agggctctga ggacatcatc    180
gtggttgccc tgtatgatta cgaggccatt caccacgaag acctcagctt ccagaagggg    240
gaccagatgg tggtcctaga ggaatccggg gagtggtgga aggctcgatc cctggccacc    300
cggaaggagg gctacatccc aagcaactat gtcgcccgcg ttgactctct ggagacagag    360
gagtggtttt tcaagggcat cagccggaag gacgcagagc gccaactgct ggctcccggc    420
aacatgctgg gctccttcat gatccgggat agcgagacca ctaaaggaag ctactctttg    480
tccgtgcgag actacgaccc tcggcaggga gataccgtga acattacaa gatccggacc     540
ctggacaacg ggggcttcta catatccccc cgaagcacct tcagcactct gcaggagctg    600
gtggaccact acaagaaggg gaacgacggg ctctgccaga aactgtcggt gccctgcatg    660
tcttccaagc cccagaagcc ttgggagaaa gatgcctggg agatccctcg ggaatccctc    720
aagctggaga gaaacttgg agctgggcag tttgggggaag tctggatggc cacctacaac    780
aagcacacca aggtggcagt gaagacgatg aagccaggga gcatgtcggt ggaggccttc    840
ctggcagagg ccaacgtgat gaaaactctg cagcatgaca agctggtcaa acttcatgcg    900
gtggtcacca aggagcccat ctacatcatc acggagttca tggccaaagg aagcttgctg    960
gactttctga aaagtgatga gggcagcaag cagccattgc caaaactcat tgacttctca   1020
gcccagattg cagaaggcat ggccttcatc gagcagagga actacatcca ccgagacctc   1080
cgagctgcca acatcttggt ctctgcatcc ctggtgtgta agattgctga ctttggcctg   1140
gcccgggtca ttgaggacaa cgagtacacg gctcggaag gggccaagtt ccccatcaag    1200
tggacagctc ctgaagccat caactttggc tccttcacca tcaagtcaga cgtctggtcc   1260
tttggtatcc tgctgatgga gatcgtcacc tacggccgga tcccttaccc agggatgtca   1320
aaccctgaag tgatccgagc tctgagcgt ggataccgga tgcctcgccc agagaactgc    1380
ccagaggagc tctacaacat catgatgcgc tgctggaaaa accgtccgga ggagcggccg   1440
accttcgaat acatccagag tgtgctggat gacttctaca cggccacaga gagccagtac   1500
caacagcagc catga                                                    1515
```

SEQ ID NO: 252 Human HCK proto-oncogene cDNA, transcript variant 2 (NM_001172131.1)

```
atgggtgca tgaagtccaa gttcctccag gtcggaggca atacattctc aaaaactgaa      60
accagcgcca gcccacactg tcctgtgtac gtgccggatc ccacatccac catcaagccg    120
gggcctaata gccacaacag caacacacca ggaatcaggg agggctctga ggacatcatc    180
gtggttgccc tgtatgatta cgaggccatt caccacgaag acctcagctt ccagaagggg    240
gaccagatgg tggtcctaga ggaatccggg gagtggtgga aggctcgatc cctggccacc    300
cggaaggagg gctacatccc aagcaactat gtcgcccgcg ttgactctct ggagacagag    360
gagtggtttt tcaagggcat cagccggaag gacgcagagc gccaactgct ggctcccggc    420
aacatgctgg gctccttcat gatccgggat agcgagacca ctaaaggaag ctactctttg    480
tccgtgcgag actacgaccc tcggcaggga gataccgtga acattacaa gatccggacc     540
ctggacaacg ggggcttcta catatccccc cgaagcacct tcagcactct gcaggagctg    600
gtggaccact acaagaaggg gaacgacggg ctctgccaga aactgtcggt gccctgcatg    660
tcttccaagc cccagaagcc ttgggagaaa gatgcctggg agatccctcg ggaatccctc    720
aagctggaga gaaacttgg agctgggcag tttgggggaag tctggatggc cacctacaac    780
aagcacacca aggtggcagt gaagacgatg aagccaggga gcatgtcggt ggaggccttc    840
ctggcagagg ccaacgtgat gaaaactctg cagcatgaca agctggtcaa acttcatgcg    900
gtggtcacca aggagcccat ctacatcatc acggagttca tggccaaagg aagcttgctg    960
gactttctga aaagtgatga gggcagcaag cagccattgc caaaactcat tgacttctca   1020
gcccagattg cagaaggcat ggccttcatc gagcagagga actacatcca ccgagacctc   1080
cgagctgcca acatcttggt ctctgcatcc ctggtgtgta agattgctga ctttggcctg   1140
gcccgggtca ttgaggacaa cgagtacacg gctcggaag gggccaagtt ccccatcaag    1200
tggacagctc ctgaagccat caactttggc tccttcacca tcaagtcaga cgtctggtcc   1260
tttggtatcc tgctgatgga gatcgtcacc tacggccgga tcccttaccc agggatgtca   1320
aaccctgaag tgatccgagc tctgagcgt ggataccgga tgcctcgccc agagaactgc    1380
ccagaggagc tctacaacat catgatgcgc tgctggaaaa accgtccgga ggagcggccg   1440
accttcgaat acatccagag tgtgctggat gacttctaca cggccacaga gagccagtac   1500
caacagcagc catga                                                    1515
```

SEQ ID NO: 253 Human HCK proto-oncogene cDNA, transcript variant 3 (NM_001172132.1)

```
atgatgggt gcatgaagtc caagttcctc caggtcggag gcaatacatt ctcaaaaact      60
gaaaccagcg ccagcccaca ctgtcctgtg tacgtgccgg atcccacatc caccatcaag    120
ccggggccta atagccacaa cagcaacaca ccaggaatca gggaggcagg ctctgaggac    180
atcatcgtgg ttgccctgta tgattacgag gccattcacc acgaagacct cagcttccag    240
aaggggacc agatggtggt cctagaggaa tccggggagt ggtggaaggc tcgatccctg     300
gccacccgga aggagggcta catcccaagc aactatgtcg cccgcgttga ctctctggag    360
acagaggagt ggttttttcaa gggcatcagc cggaaggacg cagagcgcca actgctggct    420
cccggcaaca tgctgggctc cttcatgatc cgggatagcg agaccactaa aggaagctac    480
tctttgtccg tgcgagacta cgaccctcgg cagggagata ccgtgaaaca ttacaagatc    540
cggaccctgg acaacggggg cttctacata tcccccgaa gcacctttcag cactctgcag    600
gagctggtgg accactacaa gaaggggaac gacgggctct gccagaaact gtcggtgccc    660
tgcatgtctt ccaagcccca gaagccttgg gagaaagatg cctgggagat ccctcgggaa    720
tccctcaagc tggagaagaa acttggagct gggcagtttg ggaagtctg gatggccacc     780
tacaacaagc acaccaaggt ggcagtgaag acgatgaagc cagggagcat gtcggtggag    840
gccttcctgg cagaggccaa cgtgatgaaa actctgcagc atgacaagct ggtcaaactt    900
catgcggtgg tcaccaagga gcccatctac atcatcacg agttcatggc caaggaagc     960
ttgctggact ttctgaaaag tgatgagggc agcaagcagc cattgccaaa actcattgac   1020
```

TABLE 2-continued

```
ttctcagccc agattgcaga aggcatggcc ttcatcgagc agaggaacta catccaccga   1080
gacctccgag ctgccaacat cttggtctct gcatccctgg tgtgtaagat tgctgacttt   1140
ggcctggccc gggtcattga ggacaacgag tacacggctc gggaaggggc caagttcccc   1200
atcaagtgga cagctcctga agccatcaac tttggctcct tcaccatcaa gtcagacgtc   1260
tggtcctttg gtatcctgct gatggagatc gtcacctacg gccggatccc ttacccaggg   1320
atgtcaaacc ctgaagtgat ccagctctg gagcgtggat accggatgcc tcgcccagag   1380
aactgcccag aggagctcta caacatcatg atgcgctgct ggaaaaaccg tccggaggag   1440
cggccgacct tcgaatacat ccagagtgtg ctggatgact tctacacggc cacagagagc   1500
cagtaccaac agcagcctg a                                              1521
```

SEQ ID NO: 254 Human HCK proto-oncogene cDNA, transcript variant 4
(NM_001172133.1)

```
atggggtgca tgaagtccaa gttcctccag gtcggaggca atacattctc aaaaactgaa    60
accagcgcca gccacactg tcctgtgtac gtgccggatc ccacatccac catcaagccg    120
gggcctaata gccacaacag caacacacca ggaatcaggg aggcaggctc tgaggacatc    180
atcgtggttg ccctgtatga ttacgaggcc attcaccacg aagacctcag cttccagaag    240
ggggaccaga tggtggtcct agaggaatcc ggggagtggt ggaaggctcg atccctggcc    300
acccggaagg agggctacat cccaagcaac tatgtcgccc gcgttgactc tctggagaca    360
gaggagtggt tttcaaggg catcagccgg aaggacgcag agcgccaact gctggctccc    420
ggcaacatgc tgggctcctt catgatccgg gatagcgaga ccactaaagg aagctactct    480
ttgtccgtgc gagactacga ccctcggcag ggagataccg tgaaacatta caagatccgg    540
accctggaca cgggggcttt ctacatatcc ccccgaagca ccttcagcac tctgcaggag    600
ctggtggacc actacaagaa ggggaacgac gggctctgcc agaaactgtc ggtgccctgc    660
atgtcttcca agcccagaa gccttgggag aaagatgatc tgggagatcc tcgggaatcc    720
ctcaagctgg agaagaaact tggagctggg cagtttgggg aagtctggat ggccacctac    780
aacaagcaca ccaaggtggc agtgaagacg atgaagccag ggagcatgtc ggtggaggcc    840
ttcctggcag aggccaacgt gatgaaaact ctgcagcatg acaagctggt caaacttcat    900
gcggtggtca ccaaggagcc catctacatc atcacggagt tcatggccaa aggaagcttg    960
ctggactttc tgaaaagtga tgagggcagc aagcagccat tgccaaaact cattgacttc   1020
tcagcccaga ttgcagaagg catggccttc atcgagcaga ggaactacat ccaccgagac   1080
ctccgagctg ccaacatctt ggtctctgca tccctggtgt gtaagattgc tgactttggc   1140
ctggcccggg tcattgagga caacgagtac acggctcggg aaggggccaa gttccccatc   1200
aagtggacag ctcctgaagc catcaacttt ggctcctcca ccatcaagtc agacgtctgg   1260
tcctttggta tcctgctgat ggagatcgtc acctacggcc ggatccctta cccagggatg   1320
tcaaaccctg aagtgatccg agctctggag cgtggatacc ggatgcctcg cccagagaac   1380
tgcccagagg agctctacaa catcatgatg cgctgctgga aaaaccgtcc ggaggagcgg   1440
ccgaccttcg aatacatcca gagtgtgctg gatgacttct acacgccac agagagccag   1500
taccaacagc agccatga                                                 1518
```

SEQ ID NO: 255 Human HCK proto-oncogene amino acid sequence,
isoform a (NP_002101.2)

```
MGGRSSCEDP GCPRDEERAP RMGCMKSKFL QVGGNIFSKT ETSASPHCPV YVPDPISTIK     60
PGPNSHNSNT PGIREAGSED IIVVALYDYE AIHHEDLSFQ KGDQMVVLEE SGEWWKARSL    120
AIRKEGYIPS NYVARVDSLE TEEWFFKGIS RKDAERQLLA PGNMLGSFMI RDSETTKGSY    180
SLSVRDYDPR QGDIVKHYKI RILDNGGFYI SPRSTESTLQ ELVDHYKKGN DGLCQKLSVP    240
CMSSKPQKPW EKDAWEIPRE SLKLEKKLGA GQFGEVWMAT YNKHTKVAVK TMKPGSMSVE    300
APFLAEANVMK TLQHDKLVKL HAVVIKEPIY IITEFMAKGS LLDFLKSDEG SKQPLPKLID    360
FSAQIAEGMA FIEQRNYIHR DLRAANILVS ASLVCKIADF GLARVIEDNE YTAREGAKFP    420
IKWIAPEAIN FGSFTIKSDV WSFGILLMEI VTYGRIPYPG MSNPEVIRAL ERGYRMPRPE    480
NCPEELYNIM MRCWKNRPEE RPTFEYIQSV LDDFYTATES QYQQQP                   526
```

SEQ ID NO: 256 Human HCK proto-oncogene amino acid sequence,
isoform b (NP_001165600.1)

```
MGCMKSKFLQ VGGNIFSKTE ISASPHCPVY VPDPISTIKP GPNSHNSNIP GIREAGSEDI     60
IVVALYDYEA IHHEDLSFQK GDQMVVLEES GEWWKARSLA TRKEGYIPSN YVARVDSLET    120
EEWFFKGISR KDAERQLLAP GNMLGSFMIR DSETTKGSYS LSVRDYDPRQ GDIVKHYKIR    180
ILDNGGFYIS PRSTESTLQE LVDHYKKGND GLCQKLSVPC MSSKPQKPWE KDAWEIPRES    240
LKLEKKLGAG QFGEVWMATY NKHTKVAVKT MKPGSMSVEA FLAEANVMKT LQHDKLVKLH    300
AVVIKEPIYI ITEFMAKGSL LDFLKSDEGS KQPLPKLIDF SAQIAEGMAF IEQRNYIHRD    360
LRAANILVSA SLVCKIADFG LARVIEDNEY TAREGAKFPI KWIAPEAINF GSFTIKSDVW    420
SFGILLMEIV TYGRIPYPGM SNPEVIRALE RGYRMPRPEN CPEELYNIMM RCWKNRPEER    480
PIFEYIQSVL DDFYTATESQ YQQQP                                          505
```

SEQ ID NO: 257 Human HCK proto-oncogene amino acid sequence,
isoform b (NP_001165604.1)

```
MGCMKSKFLQ VGGNIFSKTE ISASPHCPVY VPDPISTIKP GPNSHNSNIP GIREAGSEDI     60
IVVALYDYEA IHHEDLSFQK GDQMVVLEES GEWWKARSLA TRKEGYIPSN YVARVDSLET    120
EEWFFKGISR KDAERQLLAP GNMLGSFMIR DSETTKGSYS LSVRDYDPRQ GDIVKHYKIR    180
ILDNGGFYIS PRSTESTLQE LVDHYKKGND GLCQKLSVPC MSSKPQKPWE KDAWEIPRES    240
LKLEKKLGAG QFGEVWMATY NKHTKVAVKT MKPGSMSVEA FLAEANVMKT LQHDKLVKLH    300
AVVIKEPIYI ITEFMAKGSL LDFLKSDEGS KQPLPKLIDF SAQIAEGMAF IEQRNYIHRD    360
LRAANILVSA SLVCKIADFG LARVIEDNEY TAREGAKFPI KWIAPEAINF GSFTIKSDVW    420
SFGILLMEIV TYGRIPYPGM SNPEVIRALE RGYRMPRPEN CPEELYNIMM RCWKNRPEER    480
PIFEYIQSVL DDFYTATESQ YQQQP                                          505
```

TABLE 2-continued

SEQ ID NO: 258 Human HCK proto-oncogene amino acid sequence, isoform c (NP_001165601.1)

```
MGGRSSCEDP GCPRDEERAP RMGCMKSKFL QVGGNIFSKT ETSASPHCPV YVPDPISTIK    60
PGPNSHNSNT PGIREGSEDI IVVALYDYEA IHHEDLSFQK GDQMVVLEES GEWWKARSLA   120
TRKEGYIPSN YVARVDSLET EEWFFKGISR KDAERQLLAP GNMLGSFMIR DSETTKGSYS   180
LSVRDYDPRQ GDIVKHYKIR ILDNGGFYIS PRSTESTLQE LVDHYKKGND GLCQKLSVPC   240
MSSKPQKPWE KDAWEIPRES LKLEKKLGAG QFGEVWMATY NKHTKVAVKI MKPGSMSVEA   300
FLAEANVMKT LQHDKLVKLH AVVIKEPIYI ITEFMAKGSL LDFLKSDEGS KQPLPKLIDF   360
SAQIAEGMAF IEQRNYIHRD LRAANILVSA SLVCKIADFG LARVIEDNEY TAREGAKFPI   420
KWIAPEAINF GSFTIKSDVW SFGILLMEIV TYGRIPYPGM SNPEVI                  466
```

SEQ ID NO: 259 Human HCK proto-oncogene amino acid sequence, isoform d (NP_001165602.1)

```
MGCMKSKFLQ VGGNIFSKTE ISASPHCPVY VPDPISTIKP GPNSHNSNIP GIREGSEDII    60
VVALYDYEAI HHEDLSFQKG DQMVVLEESG EWWKARSLAT RKEGYIPSNY VARVDSLETE   120
EWFFKGISRK DAERQLLAPG NMLGSFMIRD SETTKGSYSL SVRDYDPRQG DIVKHYKIRT   180
LDNGGFYISP RSTESTLQEL VDHYKKGNDG LCQKLSVPCM SSKPQKPWEK DAWEIPRESL   240
KLEKKLGAGQ FGEVWMATYN KHTKVAVKIM KPGSMSVEAF LAEANVMKIL QHDKLVKLHA   300
VVIKEPIYII TEFMAKGSLL DFLKSDEGSK QPLPKLIDFS AQIAEGMAFI EQRNYIHRDL   360
RAANILVSAS LVCKIADFGL ARVIEDNEYT AREGAKFPIK WIAPEAINFG SETIKSDVWS   420
EGILLMEIVT YGRIPYPGMS NPEVIRALER GYRMPRPENC PEELYNIMMR CWKNRPEERP   480
TFEYIQSVLD DFYTATESQY QQQP                                         504
```

SEQ ID NO: 260 Human HCK proto-oncogene amino acid sequence, isoform e (NP_001165603.1)

```
MMGCMKSKFL QVGGNIFSKT ETSASPHCPV YVPDPISTIK PGPNSHNSNT PGIREAGSED    60
IIVVALYDYE AIHHEDLSFQ KGDQMVVLEE SGEWWKARSL AIRKEGYIPS NYVARVDSLE   120
TEEWFFKGIS RKDAERQLLA PGNMLGSFMI RDSETTKGSY SLSVRDYDPR QGDIVKHYKI   180
RILDNGGFYI SPRSTESTLQ ELVDHYKKGN DGLCQKLSVP CMSSKPQKPW EKDAWEIPRE   240
SLKLEKKLGA GQFGEVWMAT YNKHTKVAVK TMKPGSMSVE AFLAEANVMK TLQHDKLVKL   300
HAVVIKEPIY IITEFMAKGS LLDFLKSDEG SKQPLPKLID FSAQIAEGMA FIEQRNYIHR   360
DLRAANILVS ASLVCKIADF GLARVIEDNE YTAREGAKFP IKWIAPEAIN FGSFINKSDV   420
WSFGILLMEI VTYGRIPYPG MSNPEVIRAL ERGYRMPRPE NCPEELYNIM MRCWKNRPEE   480
RPTFEYIQSV LDDFYTATES QYQQQP                                       506
```

SEQ ID NO: 261 Mouse HCK proto-oncogene cDNA, transcript variant 1 (NM_010407.4)

```
atgcgtgaag tccaggttcc tccgagatgg aagcaaggcc tcaaaaacag agccaagtgc    60
caatcagaag ggccctgtgt atgtgccgga tcccacgtcc tccagcaagc tgggaccaaa   120
caacagcaac agcatgcccc agggtttgtg gagggctct gaggatacca ttgtggtcgc    180
actgtacgac tatgaggcta ttcaccgtga agacctcagc ttccagaagg gaaccagat   240
ggtggttctg gaggaggctg ggagtggtg gaaggcacgg tccctggcta ccaagaagga   300
aggctacatc ccaagcaact atgtggctcg agttaactct ttggagacag aagagtggtt   360
cttcaagggg atcagccgga aggatgcaga gcgccacctc ctggctccag caacatgct   420
gggctccttc atgatccggg acagtgagac caccaaaggg agctactgt tgtctgttcg   480
agactttgac ccccagcacg gagacaccgt gaagcactat aagatccgga cgctggacag   540
tggaggcttc tacatctctc caaggagcac cttcagcagc ctgcaggaac tcgtgctcca   600
ctacaagaag gggaaggatg ggctctgcca gaagctgtca gtgccctgtg tgtctcccaa   660
accccagaag ccatgggaga aagatgcttg ggagattccc cgagaatccc tccagatgga   720
gaagaaactt ggagctgggc agtttggaga agtgtggatg gccacctaca acaagcacac   780
caaagtggcg gtgaagacaa tgaagccagg gagcatgtcc gtgggaggcct tcctggctga   840
ggccaacctg atgaagtcgc tgcagcatga caaactggtg aagctacacg ctgtggtctc   900
tcaggagccc atctttattg tcacggagtt catggccaaa ggaagcctgc tggacttct    960
caagagtgaa gaaggcagca agcagccact gccaaaactg attgacttct cagcccagat  1020
ctcagaaggc atggccttca ttgagcagag gaactacatc caccgagacc tgagggctgc  1080
caacatctta gtctctgcat cactggtgtg taagattgct gactttgac tggcacgaat   1140
catcgaggac aatgagtaca cagctcggga aggagccaag ttcccatca agtggacagc    1200
tcctgaagcc atcaactttg gttccttcac catcaagtca gatgtctggt cctttggtat  1260
cctgctgatg gaaattgtca cctatggccg gatcccttac ccaggtatgt caaacccaga  1320
ggtgattcgg gcactagagc atgggtaccg tatgcctcga ccagataact gtccagaaga  1380
gctctacaat atcatgatcc gctctgaa gaaccgcccc gaggaacggc ccaccttga    1440
atacatccag agtgtgctgg atgacttcta cacgccacct gagagccagt atcagcagca  1500
gccttga                                                           1507
```

SEQ ID NO: 262 Mouse HCK proto-oncogene cDNA, transcript variant 1 (NM_001172117.1)

```
atgggatgcg tgaagtccag gttcctccga gatggaagca aggcctcaaa aacagagcca    60
agtgccaatc agaagggccc tgtgtatgtg ccggatccca cgtcctccag caagctggga   120
ccaaacaaca gcaacagcat gccccagggg tttgtggagg gctctgagga taccattgtg   180
gtcgcactgt acgactatga ggctattcac cgtgaagacc tcagcttcca gaagggagac   240
cagatggtgg ttctgaggag ggctgggag tggtggaagg cacggtccct ggctaccaag   300
aaggaaggct acatcccaag caactatgtg gctcgagtta actctttgga gacagaagag   360
tggttcttca aggggatcag ccggaaggat gcagagcgcc acctcctggc tccaggcaac   420
atgctgggct ccttcatgat ccgggacagt gagaccacca agggagcta ctcgttgtct   480
```

TABLE 2-continued

```
gttcgagact ttgaccccca gcacggagac accgtgaagc actataagat ccggacgctg      540
gacagtggag gcttctacat ctctccaagg agcaccttca gcagcctgca ggaactcgtg      600
ctccactaca agaagggaa ggatgggctc tgccagaagc tgtcagtgcc ctgtgtgtct       660
cccaaacccc agaagccatg ggagaaagat gcttgggaga ttcctcgaga atccctccag     720
atggagaaga aacttggagc tgggcagttt ggagaagtgt ggatgccac ctacaacaag      780
cacaccaaag tggcggtgaa gacaatgaag ccagggacga tgtccgtgga ggccttcctg     840
gctgaggcca acctgatgaa gtcgctgcag catgacaaac tggtgaagct acacgctgtg     900
gtctctcagg agcccatctt tattgtcacg gagttcatgg ccaaaggaag cctgctggac     960
tttctcaaga gtgaagaagg cagcaagcag ccactgccaa aactcattga cttctcagcc    1020
cagatctcag aaggcatggc cttcattgag cagaggaact catccaccg agacctgagg     1080
gctgccaaca tcttagtctc tgcatcactg gtgtgtaaga ttgctgactt tggactggca    1140
cgaatcatcg aggacaatga gtacacagct cgggaaggag ccaagttccc catcaagtgg    1200
acagctcctg aagccatcaa cttgggttcc ttcaccatca agtcagatgt ctggtccttt    1260
ggtatcctgc tgatggaaat tgtcacctat ggccggatcc cttacccagg tatgtcaaac    1320
ccagaggtga ttcgggcact agagcatggg taccgtatgc ctcgaccaga taactgtcca    1380
gaaagagctct acaatatcat gatccgctgc tggaagaacc gccccgagga acggcccacc    1440
tttgaataca tccagagtgt gctggatgac ttctacacgg ccactgagag ccagtatcag    1500
cagcagcctt ga                                                         1512
```

SEQ ID NO: 263 Mouse HCK proto-oncogene amino acid sequence,
isoform p59Hck (NP_034537.2)

```
MGGRSSCEDP GCPRSEGRAP RMGCVKSRFL RDGSKASKTE PSANQKGPVY VPDPISSSKL      60
GPNNSNSMPP GFVEGSEDTI VVALYDYEAI HREDLSFQKG DQMVVLEEAG EWWKARSLAT    120
KKEGYIPSNY VARVNSLETE EWFFKGISRK DAERHLLAPG NMLGSFMIRD SETTKGSYSL    180
SVRDFDPQHG DIVKHYKIRT LDSGGFYISP RSTESSLQEL VLHYKKGKDG LCQKLSVPCV    240
SPKPQKPWEK DAWEIPRESL QMEKKLGAGQ FGEVWMATYN KHTKVAVKIM KPGSMSVEAF    300
LAEANLMKSL QHDKLVKLHA VVSQEPIFIV TEFMAKGSLL DFLKSEEGSK QPLPKLIDFS    360
AQISEGMAFI EQRNYIHRDL RAANILVSAS LVCKIADFGL ARIIEDNEYT AREGAKFPIK    420
WIAPEAINFG SETIKSDVWS EGILLMEIVT YGRIPYPGMS NPEVIRALEH GYRMPRPDNC    480
PEELYNIMIR CWKNRPEERP TFEYIQSVLD DFYTATESQY QQQP                     524
```

SEQ ID NO: 264 Mouse HCK proto-oncogene amino acid sequence,
isoform p56Hck (NP_001165588.1)

```
MGCVKSRFLR DGSKASKTEP SANQKGPVYV PDPISSSKLG PNNSNSMPPG FVEGSEDTIV      60
VALYDYEAIH REDLSFQKGD QMVVLEEAGE WWKARSLATK KEGYIPSNYV ARVNSLETEE    120
WFFKGISRKD AERHLLAPGN MLGSFMIRDS ETTKGSYSLS VRDFDPQHGD TVKHYKIRIL    180
DSGGFYISPR STESSLQELV LHYKKGKDGL CQKLSVPCVS PKPQKPWEKD AWEIPRESLQ    240
MEKKLGAGQF GEVWMATYNK HTKVAVKIMK PGSMSVEAFL AEANLMKSLQ HDKLVKLHAV    300
VSQEPIFIVT EFMAKGSLLD FLKSEEGSKQ PLPKLIDFSA QISEGMAFIE QRNYIHRDLR    360
AANILVSASL VCKIADFGLA RIIEDNEYTA REGAKFPIKW TAPEAINFGS FTIKSDVWSF    420
GILLMEIVTY GRIPYPGMSN PEVIRALEHG YRMPRPDNCP EELYNIMIRC WKNRPEERPT    480
FEYIQSVLDD FYTATESQYQ QQP                                            503
```

SEQ ID NO: 265 Human SRC proto-oncogene cDNA, transcript variant 1
(NM_005417.4)

```
atgggtagca acaagagcaa gcccaaggat gccagccagc ggcgccgcag cctggagccc      60
gccgagaacg tgcacggcgc tggcggggc gctttccccg cctcgcagac ccccagcaag      120
ccagcctcgg ccgacggcca ccgcggcccc agcgcggcct tcgcccccgc ggccgccgag    180
cccaagctgt tcggaggctt caactcctcg gacaccgtca cctcccgca gagggcgggc     240
ccgctgccg gtgagtgac cacctttgtg gccctctatg actatgagtc taggacggag     300
acagacctgt ccttcaagaa aggcgagcgg ctccagattg tcaacaacac agagggagac    360
tggtggctgg cccactcgct cagcacagga cagacaggct catcccag caactacgtg      420
gcgccctcg actccatcca ggctgaggag tggtatttg gcaagatcac cagacgggag    480
tcagagcggt tactgctcaa tgcagagaac ccgagggga ccttcctcgt gcgagaaagt     540
gagaccacga aaggtgccta ctgcctctca gtgtctgact tcgacaagc caagggcctg    600
aacgtgaagc actacaagat ccgcaagctg gacagcggcg gcttctacat cacctcccgc    660
acccagttca cagcctgca gcagctggtg gcctactact ccaaacacgc cgatggcctg    720
tgccaccgcc tcaccaccgt gtgccccacg tccaagccgc agactcaggg cctgcccaag    780
gatgcctggg agatccctcg ggagtcgctg cggctggagg tcaagctggg ccagggctgc    840
tttgccgagg tgtggatggg gacctggaac ggtaccacca ggtggcccat caaaaccctg    900
aagcctggca cgatgtctcc agaggccttc ctgcaggagg cccaggtcat gaagaagctg    960
aggcatgaga agctggtgca gttgtatgct gtggtttcag aggagcccat ttacatcgtc   1020
acggagtaca tgagcaaggg gagtttgctg gactttctca aggggagac aggcaagtac   1080
ctgcggctgc ctcagctggt ggacatggct gctcagatcg cctcaggcat ggcgtacgtg   1140
gagcggatga actacgtcca ccgggacctt cgtgcagcaa acatcctggt gggagagaac   1200
ctggtgtgca aagtggccga ctttgggctg gctcggctca ttgaagacaa tgagtacacg   1260
gcgcggcaag gtgccaaatt ccccatcaag tggacggctc agaagctgc cctctatggc    1320
cgcttcacca tcaagtcgga cgtgtggtcc ttcgggatcc tgctgactga gctcaccaca   1380
aagggacggg tgcctaccc tgggatggtg aaccgcgagg tgctggacca ggtgagcgg     1440
ggctaccgga tgccctgccc gccggagtgt cccgagtccc tgcacgacct catgtgccag    1500
tgctggcgga aggagcctga ggagcggccc accttcgagt acctgcaggc cttcctggag    1560
gactacttca cgtccaccga gcccccagtac cagcccgggg agaaccctcta g           1611
```

TABLE 2-continued

SEQ ID NO: 266 Human SRC proto-oncogene cDNA, transcript variant 2
(NM_198291.2)

```
atgggtagca acaagagcaa gcccaaggat gccagccagc ggcgccgcag cctggagccc    60
gccgagaacg tgcacggcgc tggcggggc gctttccccg cctcgcagac cccagcaag   120
ccagcctcgg ccgacggcca ccgcggcccc agcgcggcct cgcccccgc ggccgccgag   180
cccaagctgt tcggaggctt caactcctcg gacaccgtca cctccccgca gagggcgggc   240
ccgctggccg gtggagtgac cacctttgtg gccctctatg actatgagtc taggacggag   300
acagacctgt ccttcaagaa aggcgagcgg ctccagattg tcaacaacac agagggagac   360
tggtggctgg cccactcgct cagcacagga cagacaggct acatcccag caactacgtg   420
gcgccctccg actccatcca ggctgaggag tggtattttg caagatcac cagacgggag   480
tcagagcggt tactgctcaa tgcagagaac ccgagaggga ccttcctcgt gcgagaaagt   540
gagaccacga aggtgccta ctgcctctca gtgtctgact cgacaacgc caagggcctc   600
aacgtgaagc actacaagat ccgcaagctg acagcggcg gcttctacat cacctcccgc   660
acccagttca acagcctgca gcagctggtg gcctactact ccaaacacgc cgatggcctg   720
tgccaccgcc tcaccaccgt gtgccccacg tccaagccgc agactcaggg cctggccaag   780
gatgcctggg agatccctcg ggagtcgctg cggctggagg tcaagctggg ccagggctgc   840
tttggcgagg tgtggatggg gacctggaac ggtaccacca gggtggccat caaaaccctg   900
aagcctggca cgatgtctcc agaggccttc ctgcaggagg cccaggtcat gaagaagctg   960
aggcatgaga agctggtgca gttgtatgct gtggtttcag aggagcccat ttacatcgtt  1020
acggagtaca tgagcaaggg gagtttgctg gactttctca aggggagac aggcaagtac  1080
ctgcggctgc ctcagctggt ggacatggct gctcagatcg cctcaggcat ggcgtacgtg  1140
gagcggatga actacgtcca ccgggacctt cgtgcagcca catcctggt gggagagaac  1200
ctggtgtgca aagtggccga cttttggggctg gtcggctca ttgaagacaa tgagtacacg  1260
gcgcggcaag gtgccaaatt ccccatcaag tggacggctc cagaagctgc cctctatggc  1320
cgcttcacca tcaagtcgga cgtgtggtcc ttcgggatcc tgctgactga gctcaccaca  1380
aagggacggg tgccctaccc tgggatggtg aaccgcgagg tgctggacca ggtggagcgg  1440
ggctaccgga tgccctgccc gccggagtgt cccgagtccc tgcacgacct catgtgccag  1500
tgctggcgga aggagcctga ggagcggccc accttcgagt acctgcaggc cttcctggag  1560
gactacttca cgtccaccga gccccagtac cagcccgggg agaacctcta g          1611
```

SEQ ID NO: 267 Human SRC proto-oncogene amino acid sequence
(NP_005408.1)

```
MGSNKSKPKD ASQRRRSLEP AENVHGAGGG AFPASQTPSK PASADGHRGP SAAFAPAAAE    60
PKLFGGFNSS DIVISPQRAG PLAGGVITTV ALYDYESRTE IDLSFKKGER LQIVNNTEGD   120
WWLAHSLSIG QTGYIPSNYV APSDSIQAEE WYEGKITRRE SERLLLNAEN PRGTFLVRES   180
ETTKGAYCLS VSDFDNAKGL NVKHYKIRKL DSGGFYITSR TQFNSLQQLV AYYSKHADGL   240
CHRLTTVCPT SKPQTQGLAK DAWEIPRESL RLEVKLGQGC FGEVWMGIWN GITRVAIKIL   300
KPGIMSPEAF LQEAQVMKKL RHEKLVQLYA VVSEEPIYIV TEYMSKGSLL DELKGEIGKY   360
LRLPQLVDMA AQIASGMAYV ERMNYVHRDL RAANILVGEN LVCKVADFGL ARLIEDNEYT   420
ARQGAKFPIK WIAPEAALYG RFTIKSDVWS EGILLTELIT KGRVPYPGMV NREVLDQVER   480
GYRMPCPPEC PESLHDLMCQ CWRKEPEERP TFEYLQAFLE DYFTSTEPQY QPGENL       536
```

SEQ ID NO: 268 Human SRC proto-oncogene amino acid sequence
(NP_938033.1)

```
MGSNKSKPKD ASQRRRSLEP AENVHGAGGG AFPASQTPSK PASADGHRGP SAAFAPAAAE    60
PKLFGGFNSS DIVISPQRAG PLAGGVITTV ALYDYESRTE IDLSFKKGER LQIVNNTEGD   120
WWLAHSLSIG QTGYIPSNYV APSDSIQAEE WYEGKITRRE SERLLLNAEN PRGTFLVRES   180
ETTKGAYCLS VSDFDNAKGL NVKHYKIRKL DSGGFYITSR TQFNSLQQLV AYYSKHADGL   240
CHRLTTVCPT SKPQTQGLAK DAWEIPRESL RLEVKLGQGC FGEVWMGIWN GITRVAIKIL   300
KPGIMSPEAF LQEAQVMKKL RHEKLVQLYA VVSEEPIYIV TEYMSKGSLL DELKGEIGKY   360
LRLPQLVDMA AQIASGMAYV ERMNYVHRDL RAANILVGEN LVCKVADFGL ARLIEDNEYT   420
ARQGAKFPIK WIAPEAALYG RFTIKSDVWS EGILLTELIT KGRVPYPGMV NREVLDQVER   480
GYRMPCPPEC PESLHDLMCQ CWRKEPEERP TFEYLQAFLE DYFTSTEPQY QPGENL       536
```

SEQ ID NO: 268 Mouse SRC proto-oncogene cDNA, transcript variant 1
(NM_009271.3)

```
atgggcagca acaagagcaa gcccaaggac gccagccagc ggcgccgcag cctggagccc    60
tcggaaaacg tgcacggggc aggggggcgc ttcccggcct cacagacacc gagcaagccc   120
gcctccgccg acggccaccg cgggcccagc gccgccttcg tgccgcccgc ggccgagccc   180
aagctcttcg gaggcttcaa ctcctcggac accgtcacct cccccgagag ggcggggcct   240
ctgcaggtg gggtgaccac ctttgtggcc ctctatgact atgagtcacg acagagact   300
gacctgtcct tcaagaaagg ggagcggctg cagattgtca ataacacgg gaaggtggat   360
gtcagagagg gagactggtg gctggcacac tcgctgagca cgggacagac cggttacatc   420
cccagcaact atgtggcgcc ctccgactcc atccaggctg aggagtggta ctttggcaag   480
atcactagag gggaatcaga gcggctgctg ctcaacgccg agaacccgag agggaccttc   540
ctcgtgagtg agagc cacaaaaggt gcctactgcc tctctgtatc cgacttcgac   600
aatgccaagg gcctaaatgt gaaacactac aagatccgca gctggacag cggcggtttc   660
tacatcacct cccgcaccca gttcaacagc ctgcagcagc tcgtggctta ctactccaaa   720
catgctgatg gcctgtgtca ccgcctcact accgtatgtc ccatccaa gcctcagacc   780
caggattgg ccaaggatgc ctgggagatc ccccggcgct ctgcgcggt ggaggtcaag   840
ctggggccagg gttgcttcgg agaggtgtgg atgggggacct ggaacggcac cacgagggtt   900
gccatcaaaa ctctgaagcc aggcaccatg tccccagagg ccttcctgca ggaggcccaa   960
gtcatgaaga aactgaggca cgagaaactg gtgcagctgt atgctgtggt gtcggaagaa  1020
cccatttaca ttgtgacaga gtacatgaac aaggggagtc tgctggactt ctcaagggg  1080
gaaacgggca atatttgcg gctaccccag ctggtggaca tgtctgctca gatcgcttca  1140
```

TABLE 2-continued

```
ggcatggcct atgtggagcg gatgaactat gtgcaccggg accttcgagc cgccaatatc   1200
ctagtagggg agaacctggt gtgcaaagtg gccgactttg ggttggcccg gctcatagaa   1260
gacaacgaat acacagcccg gcaaggtgcc aaattcccca tcaagtggac cgcccctgaa   1320
gctgctctgt acggcaggtt caccatcaag tcggatgtgt ggtcctttgg gattctgctg   1380
accgagctca ccactaaggg aagagtgccc tatcctggga tggtgaaccg tgaggttctg   1440
gaccaggtgg agcggggcta ccggatgcct tgtcccccg agtgcccga gtccctgcat    1500
gacctttatgt gccagtgctg gcggaaggag cccgaggagc ggcccacctt cgagtacctg   1560
caggccttcc tggaagacta ctttacgtcc actgagccac agtaccagcc cggggagaac   1620
ctatag                                                              1626
```

SEQ ID NO: 270 Mouse SRC proto-oncogene cDNA, transcript variant 2
(NM_001025395.2)

```
atgggcagca acaagagcaa gcccaaggac gccagccagc ggcgccgcag cctggagccc     60
tcggaaaacg tgcacggggc aggggcgcc ttcccggcct cacagacacc gagcaagccc    120
gcctccgccg acggccaccg cgggcccagc gccgccttcg tgccgcccgc ggccgagccc    180
aagctcttcg gaggcttcaa ctcctcggac accgtcacct ccccgcagag ggcgggggct    240
ctggcaggtg gggtgaccac cttgtggcc ctctatgact atgagtcacg gacagagact     300
gacctgtcct tcaagaaagg ggagcggctg cagattgtca ataacacaga gggagactgg    360
tggctggcac actcgctgag cacgggacag accggttaca tccccagcaa ctatgtggcg    420
ccctccgact ccatccaggc tgaggagtgg tactttggca agatcactag acgggaatca    480
gagcggctgc tgctcaacgc cgagaacccg agagggacct tcctcgtgag ggagagtgag    540
accacaaaag gtgcctactg cctctctgta tccgacttcg acaatgccaa gggcctaaat    600
gtgaaacact acaagatccg caagctggac agcggcggtt tctacatcac ctcccgcacc    660
cagttcaaca gcctgcagca gctcgtggct tactactcca aacatgctga tggcctgtgt    720
caccgcctca ctaccgtatg tccccacatcc aagcctcaga cccagggatt ggccaaggat    780
gcgtgggaga tcccccggga gtccctgcgg ctggaggtca agctgggcca gggttgcttc    840
ggagaggtgt ggatgggac ctggaacggc accacgaggg ttgccatcaa aactctgaag     900
ccaggcacca tgtccccaga ggccttcctg caggaggccc aagtcatgaa gaaactgagg    960
cacgagaaac tggtgcagct gtatgctgtg gtgtcggaag aacccattta cattgtgaca   1020
gagtacatga acaaggggag tctgctggac tttctcaagg gggaaacggg caaatatttg   1080
cggctacccc agctggtgga catgtctgct cagatcgctt caggcatggc ctatgtggag   1140
cggatgaact atgtgcaccg ggaccttcga gccgccaata tcctagtagg ggagaacctg   1200
gtgtgcaaag tggccgactt tgggttggcc cggctcatag aagacaacga atacacagcc   1260
cggcaaggtg ccaaattccc catcaagtgg accgccctg aagctgctct gtacggcagg   1320
ttcaccatca gtcggatgt gtggtccttt gggattctgc tgaccgagct caccactaag   1380
ggaagagtgc cctatcctgg gatggtgaac cgtgaggttc tggaccaggt ggagcggggc   1440
taccggatgc cttgtccccc cgagtgcccc gagtccctgc atgacctttat gtgccagtgc   1500
tggcggaagg agcccgagga gcggcccacc ttcgagtacc tgcaggcctt cctggaagac   1560
tactttacgt ccactgagcc acagtaccag cccggggaga acctatag                1608
```

SEQ ID NO: 271 Mouse SRC proto-oncogene amino acid sequence,
isoform 1 (NP_033297.2)

```
MGSNKSKPKD ASQRRRSLEP SENVHGAGGA FPASQTPSKP ASADGHRGPS AAFVPPAAEP    60
KLFGGFNSSD TVTSPQRAGP LAGGVTTFVA LYDYESRTET DLSFKKGERL QIVNNTRKVD   120
VREGDWWLAH SLSTGQTGYI PSNYVAPSDS IQAEEWYFGK ITRRESERLL LNAENPRGTF   180
LVRESETTKG AYCLSVSDFD NAKGLNVKHY KIRKLDSGGF YITSRTQFNS LQQLVAYYSK   240
HADGLCHRLT TVCPTSKPQT QGLAKDAWEI PRESLRLEVK LGQGCFGEVW MGTWNGTTRV   300
AIKTLKPGIM SPEAFLQEAQ VMKKLRHEKL VQLYAVVSEE PIYIVTEYMN KGSLLDFLKG   360
ETGKYLRLPQ LVDMSAQIAS GMAYVERMNY VHRDLRAANI LVGENLVCKV ADFGLARLIE   420
DNEYTARQGA KFPIKWTAPE AALYGRFTIK SDVWSFGILL TELTTKGRVP YPGMVNREVL   480
DQVERGYRMP CPPECPESLH DLMCQCWRKE PEERPTFEYL QAFLEDYFTS TEPQYQPGEN   540
L                                                                  541
```

SEQ ID NO: 272 Mouse SRC proto-oncogene amino acid sequence
isoform 2 (NP_001020566.1

```
MGSNKSKPKD ASQRRRSLEP SENVHGAGGA FPASQTPSKP ASADGHRGPS AAFVPPAAEP    60
KLFGGFNSSD TVTSPQRAGP LAGGVTTFVA LYDYESRTET DLSFKKGERL QIVNNTEGDW   120
WLAHSLSTGQ TGYIPSNYVA PSDSIQAEEW YFGKITRRES ERLLLNAENP RGTFLVRESE   180
TTKGAYCLSV SDFDNAKGLN VKHYKIRKLD SGGFYITSRT QFNSLQQLVA YYSKHADGLC   240
HRLTTVCPTS KPQTQGLAKD AWEIPRESLR LEVKLGQGCF GEVWMGTWNG TTRVAIKTLK   300
PGTMSPEAFL QEAQVMKKLR HEKLVQLYAV VSEEPIYIVT EYMNKGSLLD FLKGETGKYL   360
RLPQLVDMSA QIASGMAYVE RMNYVHRDLR AANILVGENL VCKVADFGLA RLIEDNEYTA   420
RQGAKFPIKW TAPEAALYGR FTIKSDVWSF GILLTELTTK GRVPYPGMVN REVLDQVERG   480
YRMPCPPECP ESLHDLMCQC WRKEPEERPT FEYLQAFLED YFTSTEPQYQ PGENL        535
```

Included in Table 2 are RNA nucleic acid molecules (e.g., thymines replaced with uredines), nucleic acid molecules encoding orthologs of the encoded proteins, as well as DNA or RNA nucleic acid sequences comprising a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with the nucleic acid sequence of any SEQ ID NO listed in Table 2, or a portion thereof. Such nucleic acid molecules can have a function of the full-length nucleic acid as described further herein.

Included in Table 2 are orthologs of the proteins, as well as polypeptide molecules comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with an amino acid sequence of any SEQ ID NO listed in Table 2, or a portion thereof. Such polypeptides can have a function of the full-length polypeptide as described further herein.

Included in Table 2 are modified human PAK2 proteins and nucleic acids encoding same, such as autophosphorylated PAK2 at Serine 141 (S141), phosphorylated PAK2 at Tyrosine 130 (Y130), phosphorylated PAK2 at Tyrosine 139 (Y139), phosphorylated PAK2 at Tyrosine 194 (Y194), phosphorylation defective PAK2 Tyrosine at amino acid residue 130 mutated to a Phenylalanine (Y130P), phosphorylation defective PAK2 Tyrosine at amino acid residue 139 mutated to a Phenylalanine (Y139P), phosphorylation defective PAK2 Tyrosine at amino acid residue 194 mutated to a Phenylalanine (Y194P), as well as corresponding modifications of such amino acid residues and phosphorylation status thereof in orthologs of human PAK2.

II. Subjects

In one embodiment, the subject for whom predicted likelihood of efficacy of a SFKSP therapy is determined, is a mammal (e.g., mouse, rat, primate, non-human mammal, domestic animal, such as a dog, cat, cow, horse, and the like), and is preferably a human. In one embodiment, the subject for whom therapy is administered, is a mammal (e.g., mouse, rat, primate, non-human mammal, domestic animal, such as a dog, cat, cow, horse, and the like), and is preferably a human. In another embodiment, the subject is an animal model of a breast cancer, such as an ER+ breast cancer and/or estrogen therapy-resistant cancer. For example, the animal model can be an orthotopic xenograft animal model of a human-derived breast cancer, such as an ER+ breast cancer and/or estrogen therapy-resistant cancer.

In another embodiment of the methods of the present invention, the subject has not undergone treatment, such as endocrine therapy, chemotherapy, radiation therapy, targeted therapy, and/or SFKSP therapy. In still another embodiment, the subject has undergone treatment, such as endocrine therapy, chemotherapy, radiation therapy, targeted therapy, and/or SFKSP therapy.

In certain embodiments, the subject has had surgery to remove cancerous or precancerous tissue. In other embodiments, the cancerous tissue has not been removed, e.g., the cancerous tissue may be located in an inoperable region of the body, such as in a tissue that is essential for life, or in a region where a surgical procedure would cause considerable risk of harm to the patient.

The methods of the present invention can be used to determine the responsiveness to SFKSP therapies of many different endocrine resistant breast cancers in subjects such as those described herein.

III. Sample Collection, Preparation and Separation

In some embodiments, biomarker amount and/or activity measurement(s) in a sample from a subject is compared to a predetermined control (standard) sample. The sample from the subject is typically from a diseased tissue, such as cancer cells or tissues. The control sample can be from the same subject or from a different subject. The control sample is typically a normal, non-diseased sample. However, in some embodiments, such as for staging of disease or for evaluating the efficacy of treatment, the control sample can be from a diseased tissue. The control sample can be a combination of samples from several different subjects. In some embodiments, the biomarker amount and/or activity measurement(s) from a subject is compared to a pre-determined level. This pre-determined level is typically obtained from normal samples. As described herein, a "pre-determined" biomarker amount and/or activity measurement(s) may be a biomarker amount and/or activity measurement(s) used to, by way of example only, evaluate a subject that may be selected for treatment, evaluate a response to a SFKSP therapy, and/or evaluate a response to a combination SFKSP therapy (e.g., one or more SFKSP inhibitors alone, or in combination with one or more additional CSK activator). A pre-determined biomarker amount and/or activity measurement(s) may be determined in populations of patients with or without cancer. The pre-determined biomarker amount and/or activity measurement(s) can be a single number, equally applicable to every patient, or the pre-determined biomarker amount and/or activity measurement(s) can vary according to specific subpopulations of patients. Age, weight, height, and other factors of a subject may affect the pre-determined biomarker amount and/or activity measurement(s) of the individual. Furthermore, the pre-determined biomarker amount and/or activity can be determined for each subject individually. In one embodiment, the amounts determined and/or compared in a method described herein are based on absolute measurements.

In another embodiment, the amounts determined and/or compared in a method described herein are based on relative measurements, such as ratios (e.g., biomarker copy numbers, level, and/or activity before a treatment vs. after a treatment, such biomarker measurements relative to a spiked or man-made control, such biomarker measurements relative to the expression of a housekeeping gene, and the like). For example, the relative analysis can be based on the ratio of pre-treatment biomarker measurement as compared to post-treatment biomarker measurement. Pre-treatment biomarker measurement can be made at any time prior to initiation of anti-cancer therapy. Post-treatment biomarker measurement can be made at any time after initiation of anti-cancer therapy. In some embodiments, post-treatment biomarker measurements are made 1, 2, 3, 4, 5, 6, 7, 8, 9, 10, 11, 12, 13, 14, 15, 16, 17, 18, 19, 20 weeks or more after initiation of anti-cancer therapy, and even longer toward indefinitely for continued monitoring. Treatment can comprise anti-cancer therapy, such as a therapeutic regimen comprising one or more SFKSP inhibitors alone or in combination with other anti-cancer agents, such as CSK activators.

The pre-determined biomarker amount and/or activity measurement(s) can be any suitable standard. For example, the pre-determined biomarker amount and/or activity measurement(s) can be obtained from the same or a different human for whom a patient selection is being assessed. In one embodiment, the pre-determined biomarker amount and/or activity measurement(s) can be obtained from a previous assessment of the same patient. In such a manner, the progress of the selection of the patient can be monitored over time. In addition, the control can be obtained from an assessment of another human or multiple humans, e.g., selected groups of humans, if the subject is a human. In such a manner, the extent of the selection of the human for whom selection is being assessed can be compared to suitable other humans, e.g., other humans who are in a similar situation to the human of interest, such as those suffering from similar or the same condition(s) and/or of the same ethnic group.

In some embodiments of the present invention the change of biomarker amount and/or activity measurement(s) from the pre-determined level is about 0.1, 0.2, 0.3, 0.4, 0.5, 0.6, 0.7, 0.8, 0.9, 1.0, 1.5, 2.0, 2.5, 3.0, 3.5, 4.0, 4.5, or 5.0 fold or greater, or any range in between, inclusive. Such cutoff values apply equally when the measurement is based on relative changes, such as based on the ratio of pre-treatment biomarker measurement as compared to post-treatment biomarker measurement. In some embodiments of the present invention the change of biomarker amount and/or activity measurement(s) from the pre-determined level is about 0.5 fold, about 1.0 fold, about 1.5 fold, about 2.0 fold, about 2.5 fold, about 3.0 fold, about 3.5 fold, about 4.0 fold, about 4.5 fold, or about 5.0 fold or greater. In some embodiments, the fold change is less than about 1, less than about 5, less than about 10, less than about 20, less than about 30, less than about 40, or less than about 50. In other embodiments, the fold change in biomarker amount and/or activity measurement(s) compared to a predetermined level is more than about 1, more than about 5, more than about 10, more than about 20, more than about 30, more than about 40, or more than about 50.

Biological samples can be collected from a variety of sources from a patient including a body fluid sample, cell sample, or a tissue sample comprising nucleic acids and/or proteins. "Body fluids" refer to fluids that are excreted or secreted from the body as well as fluids that are normally not (e.g., amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit). In a preferred embodiment, the subject and/or control sample is selected from the group consisting of cells, cell lines, histological slides, paraffin embedded tissues, biopsies, whole blood, nipple aspirate, serum, plasma, buccal scrape, saliva, cerebrospinal fluid, urine, stool, and bone marrow. In one embodiment, the sample is serum, plasma, or urine. IN another embodiment, the sample is serum.

The samples can be collected from individuals repeatedly over a longitudinal period of time (e.g., once or more on the order of days, weeks, months, annually, biannually, etc.). Obtaining numerous samples from an individual over a period of time can be used to verify results from earlier detections and/or to identify an alteration in biological pattern as a result of, for example, disease progression, drug treatment, etc. For example, subject samples can be taken and monitored every month, every two months, or combinations of one, two, or three month intervals according to the present invention. In addition, the biomarker amount and/or activity measurements of the subject obtained over time can be conveniently compared with each other, as well as with those of normal controls during the monitoring period, thereby providing the subject's own values, as an internal, or personal, control for long-term monitoring.

Sample preparation and separation can involve any of the procedures, depending on the type of sample collected and/or analysis of biomarker measurement(s). Such procedures include, by way of example only, concentration, dilution, adjustment of pH, removal of high abundance polypeptides (e.g., albumin, gamma globulin, and transferrin, etc.), addition of preservatives and calibrants, addition of protease inhibitors, addition of denaturants, desalting of samples, concentration of sample proteins, extraction and purification of lipids.

The sample preparation can also isolate molecules that are bound in non-covalent complexes to other protein (e.g., carrier proteins). This process may isolate those molecules bound to a specific carrier protein (e.g., albumin), or use a more general process, such as the release of bound molecules from all carrier proteins via protein denaturation, for example using an acid, followed by removal of the carrier proteins.

Removal of undesired proteins (e.g., high abundance, uninformative, or undetectable proteins) from a sample can be achieved using high affinity reagents, high molecular weight filters, ultracentrifugation and/or electrodialysis. High affinity reagents include antibodies or other reagents (e.g., aptamers) that selectively bind to high abundance proteins. Sample preparation could also include ion exchange chromatography, metal ion affinity chromatography, gel filtration, hydrophobic chromatography, chromatofocusing, adsorption chromatography, isoelectric focusing and related techniques. Molecular weight filters include membranes that separate molecules on the basis of size and molecular weight. Such filters may further employ reverse osmosis, nanofiltration, ultrafiltration and microfiltration.

Ultracentrifugation is a method for removing undesired polypeptides from a sample. Ultracentrifugation is the centrifugation of a sample at about 15,000-60,000 rpm while monitoring with an optical system the sedimentation (or lack thereof) of particles. Electrodialysis is a procedure which uses an electromembrane or semipermable membrane in a process in which ions are transported through semi-permeable membranes from one solution to another under the influence of a potential gradient. Since the membranes used in electrodialysis may have the ability to selectively transport ions having positive or negative charge, reject ions of the opposite charge, or to allow species to migrate through a semipermable membrane based on size and charge, it renders electrodialysis useful for concentration, removal, or separation of electrolytes.

Separation and purification in the present invention may include any procedure known in the art, such as capillary electrophoresis (e.g., in capillary or on-chip) or chromatography (e.g., in capillary, column or on a chip). Electrophoresis is a method which can be used to separate ionic molecules under the influence of an electric field. Electrophoresis can be conducted in a gel, capillary, or in a microchannel on a chip. Examples of gels used for electrophoresis include starch, acrylamide, polyethylene oxides, agarose, or combinations thereof. A gel can be modified by its cross-linking, addition of detergents, or denaturants, immobilization of enzymes or antibodies (affinity electrophoresis) or substrates (zymography) and incorporation of a pH gradient. Examples of capillaries used for electrophoresis include capillaries that interface with an electrospray.

Capillary electrophoresis (CE) is preferred for separating complex hydrophilic molecules and highly charged solutes. CE technology can also be implemented on microfluidic chips. Depending on the types of capillary and buffers used, CE can be further segmented into separation techniques such as capillary zone electrophoresis (CZE), capillary isoelectric focusing (LIEF), capillary isotachophoresis (cITP) and capillary electrochromatography (CEC). An embodiment to couple CE techniques to electrospray ionization involves the use of volatile solutions, for example, aqueous mixtures containing a volatile acid and/or base and an organic such as an alcohol or acetonitrile.

Capillary isotachophoresis (cITP) is a technique in which the analytes move through the capillary at a constant speed but are nevertheless separated by their respective mobilities. Capillary zone electrophoresis (CZE), also known as free-solution CE (FSCE), is based on differences in the electrophoretic mobility of the species, determined by the charge on the molecule, and the frictional resistance the molecule encounters during migration which is often directly proportional to the size of the molecule. Capillary isoelectric focusing (LIEF) allows weakly-ionizable amphoteric molecules, to be separated by electrophoresis in a pH gradient. CEC is a hybrid technique between traditional high performance liquid chromatography (HPLC) and CE.

Separation and purification techniques used in the present invention include any chromatography procedures known in the art. Chromatography can be based on the differential adsorption and elution of certain analytes or partitioning of analytes between mobile and stationary phases. Different examples of chromatography include, but not limited to, liquid chromatography (LC), gas chromatography (GC), high performance liquid chromatography (HPLC), etc.

IV. Biomarker Nucleic Acids and Polypeptides

One aspect of the present invention pertains to the use of isolated nucleic acid molecules that correspond to biomarker nucleic acids that encode a biomarker polypeptide or a portion of such a polypeptide. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

A biomarker nucleic acid molecule of the present invention can be isolated using standard molecular biology techniques and the sequence information in the database records described herein. Using all or a portion of such nucleic acid sequences, nucleic acid molecules of the present invention can be isolated using standard hybridization and cloning techniques (e.g., as described in Sambrook et al., ed., *Molecular Cloning: A Laboratory Manual, 2nd ed.*, Cold Spring Harbor Laboratory Press, Cold Spring Harbor, N.Y., 1989).

A nucleic acid molecule of the present invention can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the present invention can be prepared by standard synthetic techniques, e.g., using an automated DNA synthesizer.

Moreover, a nucleic acid molecule of the present invention can comprise only a portion of a nucleic acid sequence, wherein the full length nucleic acid sequence comprises a marker of the present invention or which encodes a polypeptide corresponding to a marker of the present invention. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a biomarker nucleic acid sequence. Probes based on the sequence of a biomarker nucleic acid molecule can be used to detect transcripts or genomic sequences corresponding to one or more markers of the present invention. The probe comprises a label group attached thereto, e.g., a radioisotope, a fluorescent compound, an enzyme, or an enzyme co-factor.

A biomarker nucleic acid molecules that differ, due to degeneracy of the genetic code, from the nucleotide sequence of nucleic acid molecules encoding a protein which corresponds to the biomarker, and thus encode the same protein, are also contemplated.

In addition, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

The term "allele," which is used interchangeably herein with "allelic variant," refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene or allele. For example, biomarker alleles can differ from each other in a single nucleotide, or several nucleotides, and can include substitutions, deletions, and insertions of nucleotides. An allele of a gene can also be a form of a gene containing one or more mutations.

The term "allelic variant of a polymorphic region of gene" or "allelic variant", used interchangeably herein, refers to an alternative form of a gene having one of several possible nucleotide sequences found in that region of the gene in the population. As used herein, allelic variant is meant to encompass functional allelic variants, non-functional allelic variants, SNPs, mutations and polymorphisms.

The term "single nucleotide polymorphism" (SNP) refers to a polymorphic site occupied by a single nucleotide, which is the site of variation between allelic sequences. The site is usually preceded by and followed by highly conserved sequences of the allele (e.g., sequences that vary in less than $\frac{1}{100}$ or $\frac{1}{1000}$ members of a population). A SNP usually arises due to substitution of one nucleotide for another at the polymorphic site. SNPs can also arise from a deletion of a nucleotide or an insertion of a nucleotide relative to a reference allele. Typically the polymorphic site is occupied by a base other than the reference base. For example, where the reference allele contains the base "T" (thymidine) at the polymorphic site, the altered allele can contain a "C" (cytidine), "G" (guanine), or "A" (adenine) at the polymorphic site. SNP's may occur in protein-coding nucleic acid sequences, in which case they may give rise to a defective or otherwise variant protein, or genetic disease. Such a SNP may alter the coding sequence of the gene and therefore specify another amino acid (a "missense" SNP) or a SNP may introduce a stop codon (a "nonsense" SNP). When a SNP does not alter the amino acid sequence of a protein, the SNP is called "silent." SNP's may also occur in noncoding regions of the nucleotide sequence. This may result in defective protein expression, e.g., as a result of alternative spicing, or it may have no effect on the function of the protein.

As used herein, the terms "gene" and "recombinant gene" refer to nucleic acid molecules comprising an open reading frame encoding a polypeptide corresponding to a marker of the present invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the present invention.

In another embodiment, a biomarker nucleic acid molecule is at least 7, 15, 20, 25, 30, 40, 60, 80, 100, 150, 200, 250, 300, 350, 400, 450, 550, 650, 700, 800, 900, 1000, 1100, 1200, 1300, 1400, 1500, 1600, 1700, 1800, 1900, 2000, 2200, 2400, 2600, 2800, 3000, 3500, 4000, 4500, or more nucleotides in length and hybridizes under stringent conditions to a nucleic acid molecule corresponding to a marker of the present invention or to a nucleic acid molecule encoding a protein corresponding to a marker of the present invention. As used herein, the term "hybridizes under stringent conditions" is intended to describe conditions for hybridization and washing under which nucleotide sequences at least 60% (65%, 70%, 75%, 80%, preferably 85%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the present invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the present invention pertains to nucleic acid molecules encoding a polypeptide of the present invention that contain changes in amino acid residues that are not essential for activity. Such polypeptides differ in amino acid sequence from the naturally-occurring proteins which correspond to the markers of the present invention, yet retain biological activity. In one embodiment, a biomarker protein has an amino acid sequence that is at least about 40% identical, 50%, 60%, 70%, 75%, 80%, 83%, 85%, 87.5%, 90%, 91%, 92%, 93%, 94%, 95%, 96%, 97%, 98%, 99% or identical to the amino acid sequence of a biomarker protein described herein.

An isolated nucleic acid molecule encoding a variant protein can be created by introducing one or more nucleotide substitutions, additions or deletions into the nucleotide sequence of nucleic acids of the present invention, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

In some embodiments, the present invention further contemplates the use of anti-biomarker antisense nucleic acid molecules, i.e., molecules which are complementary to a sense nucleic acid of the present invention, e.g., complementary to the coding strand of a double-stranded cDNA molecule corresponding to a marker of the present invention or complementary to an mRNA sequence corresponding to a marker of the present invention. Accordingly, an antisense nucleic acid molecule of the present invention can hydrogen bond to (i.e. anneal with) a sense nucleic acid of the present invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the present invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been sub-cloned in an antisense orientation (i.e., RNA transcribed from the inserted nucleic acid will be of an antisense orientation to a target nucleic acid of interest, described further in the following subsection).

The antisense nucleic acid molecules of the present invention are typically administered to a subject or generated in situ such that they hybridize with or bind to cellular mRNA and/or genomic DNA encoding a polypeptide corresponding to a selected marker of the present invention to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the present invention includes direct injection at a tissue site or infusion of the antisense nucleic acid into a blood- or bone marrow-associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the present invention can be an α-anomeric nucleic acid molecule. An α-anomeric nucleic acid molecule forms specific double-stranded hybrids with complementary RNA in which, contrary to the usual α-units, the strands run parallel to each other (Gaultier et al., 1987, *Nucleic Acids Res.* 15:6625-6641). The antisense nucleic acid molecule can also comprise a 2'-o-methylribonucleotide (Inoue et al., 1987, *Nucleic Acids Res.* 15:6131-6148) or a chimeric RNA-DNA analogue (Inoue et al., 1987, *FEBS Lett.* 215:327-330).

The present invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach, 1988, *Nature* 334:585-591) can be used to catalytically cleave mRNA transcripts to thereby inhibit translation of the protein encoded by the mRNA. A ribozyme having specificity for a nucleic acid molecule encoding a polypeptide corresponding to a marker of the present invention can be designed based upon the nucleotide sequence of a cDNA corresponding to the marker. For example, a derivative of a Tetrahymena L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the present invention can be used to select a catalytic RNA having a specific ribonuclease activity from a pool of RNA molecules (see, e.g., Bartel and Szostak, 1993, *Science* 261:1411-1418).

The present invention also encompasses nucleic acid molecules which form triple helical structures. For example, expression of a biomarker protein can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660:27-36; and Maher (1992) *Bioassays* 14(12):807-15.

In various embodiments, the nucleic acid molecules of the present invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acid molecules (see Hyrup et al., 1996, *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, *Proc. Natl. Acad. Sci. USA* 93:14670-675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., 1989, *Nucleic Acids Res.* 17:5973-88). PNA monomers are then coupled in a step-wise manner to produce a chimeric molecule with a 5' PNA segment and a 3' DNA segment (Finn et al., 1996, *Nucleic Acids Res.* 24(17):3357-63). Alternatively, chimeric molecules can be synthesized with a 5' DNA segment and a 3' PNA segment (Peterser et al., 1975, *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al., 1989, *Proc. Natl. Acad. Sci. USA* 86:6553-6556; Lemaitre et al., 1987, *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al., 1988, *Bio/Techniques* 6:958-976) or intercalating agents (see, e.g., Zon, 1988, *Pharm. Res.* 5:539-549). To this end, the oligonucleotide can be conjugated to another molecule, e.g., a peptide, hybridization triggered cross-linking agent, transport agent, hybridization-triggered cleavage agent, etc.

Another aspect of the present invention pertains to the use of biomarker proteins and biologically active portions thereof. In one embodiment, the native polypeptide corresponding to a marker can be isolated from cells or tissue sources by an appropriate purification scheme using standard protein purification techniques. In another embodiment, polypeptides corresponding to a marker of the present invention are produced by recombinant DNA techniques. Alternative to recombinant expression, a polypeptide corresponding to a marker of the present invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a biomarker polypeptide include polypeptides comprising amino acid sequences sufficiently identical to or derived from a biomarker protein amino acid sequence described herein, but which includes fewer amino acids than the full length protein, and exhibit at least one activity of the corresponding full-length protein. Typically, biologically active portions comprise a domain or motif with at least one activity of the corresponding protein. A biologically active portion of a protein of the present invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the present invention.

Preferred polypeptides have an amino acid sequence of a biomarker protein encoded by a nucleic acid molecule described herein. Other useful proteins are substantially identical (e.g., at least about 40%, preferably 50%, 60%, 70%, 75%, 80%, 83%, 85%, 88%, 90%, 91%, 92%, 93%, 94%, 95%, 96%, 97%, 98%, or 99%) to one of these sequences and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules of the present invention. BLAST protein searches can be performed with the XBLAST program, score=50, wordlength=3 to obtain amino acid sequences homologous to a protein molecules of the present invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another preferred, non-limiting example of a mathematical algorithm utilized for the comparison of sequences is the algorithm of Myers and Miller, (1988) *Comput Appl Biosci,* 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The present invention also provides chimeric or fusion proteins corresponding to a biomarker protein. As used herein, a "chimeric protein" or "fusion protein" comprises all or part (preferably a biologically active part) of a polypeptide corresponding to a marker of the present invention operably linked to a heterologous polypeptide (i.e., a polypeptide other than the polypeptide corresponding to the marker). Within the fusion protein, the term "operably linked" is intended to indicate that the polypeptide of the present invention and the heterologous polypeptide are fused in-frame to each other. The heterologous polypeptide can be fused to the amino-terminus or the carboxyl-terminus of the polypeptide of the present invention.

One useful fusion protein is a GST fusion protein in which a polypeptide corresponding to a marker of the present invention is fused to the carboxyl terminus of GST sequences. Such fusion proteins can facilitate the purification of a recombinant polypeptide of the present invention.

In another embodiment, the fusion protein contains a heterologous signal sequence, immunoglobulin fusion protein, toxin, or other useful protein sequence. Chimeric and fusion proteins of the present invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the present invention can be cloned into such an expression vector such that the fusion moiety is linked in-frame to the polypeptide of the present invention.

A signal sequence can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the present invention pertains to the described polypeptides having a signal sequence, as well as to polypeptides from which the signal sequence has been proteolytically cleaved (i.e., the cleavage products). In one embodiment, a nucleic acid sequence encoding a signal sequence can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the biomarker polypeptides described herein. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a biomarker protein which function as either agonists (mimetics) or as antagonists can be identified by screening combinatorial libraries of mutants, e.g., truncation mutants, of the protein of the present invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the polypeptides of the present invention from a degenerate oligonucleotide sequence. Methods for synthesizing degenerate oligonucleotides are known in the art (see, e.g., Narang, 1983, *Tetrahedron* 39:3; Itakura et al., 1984, *Annu. Rev. Biochem.* 53:323; Itakura et al., 1984, *Science* 198:1056; Ike et al., 1983 *Nucleic Acid Res.* 11:477).

In addition, libraries of fragments of the coding sequence of a polypeptide corresponding to a marker of the present invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the present invention (Arkin and Yourvan, 1992, *Proc. Natl. Acad. Sci. USA* 89:7811-7815; Delgrave et al., 1993, *Protein Engineering* 6(3):327-331).

The production and use of biomarker nucleic acid and/or biomarker polypeptide molecules described herein can be facilitated by using standard recombinant techniques. In some embodiments, such techniques use vectors, preferably expression vectors, containing a nucleic acid encoding a biomarker polypeptide or a portion of such a polypeptide. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, namely expression vectors, are capable of directing the expression of genes to which they are operably linked. In general, expression vectors of utility in recombinant DNA techniques are often in the form of plasmids (vectors). However, the present invention is intended to include such other forms of expression vectors, such as viral vectors (e.g., replication defective retroviruses, adenoviruses and adeno-associated viruses), which serve equivalent functions.

The recombinant expression vectors of the present invention comprise a nucleic acid of the present invention in a form suitable for expression of the nucleic acid in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Methods in Enzymology: Gene Expression Technology* vol. 185, Academic Press, San Diego, Calif. (1991). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the present invention can be introduced into host cells to thereby produce proteins or peptides, including fusion proteins or peptides, encoded by nucleic acids as described herein.

The recombinant expression vectors for use in the present invention can be designed for expression of a polypeptide corresponding to a marker of the present invention in prokaryotic (e.g., *E. coli*) or eukaryotic cells (e.g., insect cells {using baculovirus expression vectors}, yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, Mass.) and pRITS (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., 1988, *Gene* 69:301-315) and pET 11d (Studier et al., p. 60-89, In *Gene Expression Technology: Methods in Enzymology* vol. 185, Academic Press, San Diego, Calif., 1991). Target biomarker nucleic acid expression from the pTrc vector relies on host RNA polymerase transcription from a hybrid trp-lac fusion promoter. Target biomarker nucleic acid expression from the pET 11d vector relies on transcription from a T7 gn10-lac fusion promoter mediated by a co-expressed viral RNA polymerase (T7 gni). This viral polymerase is supplied by host strains BL21 (DE3) or HMS174(DE3) from a resident prophage harboring a T7 gnl gene under the transcriptional control of the lacUV 5 promoter.

One strategy to maximize recombinant protein expression in *E. coli* is to express the protein in a host bacterium with an impaired capacity to proteolytically cleave the recombinant protein (Gottesman, p. 119-128, In *Gene Expression Technology: Methods in Enzymology* vol. 185, Academic Press, San Diego, Calif., 1990. Another strategy is to alter the nucleic acid sequence of the nucleic acid to be inserted into an expression vector so that the individual codons for each amino acid are those preferentially utilized in *E. coli* (Wada et al., 1992, *Nucleic Acids Res.* 20:2111-2118). Such alteration of nucleic acid sequences of the present invention can be carried out by standard DNA synthesis techniques.

In another embodiment, the expression vector is a yeast expression vector. Examples of vectors for expression in yeast *S. cerevisiae* include pYepSec1 (Baldari et al., 1987, *EMBO J.* 6:229-234), pMFa (Kurjan and Herskowitz, 1982, *Cell* 30:933-943), pJRY88 (Schultz et al., 1987, *Gene* 54:113-123), pYES2 (Invitrogen Corporation, San Diego, Calif.), and pPicZ (Invitrogen Corp, San Diego, Calif.).

Alternatively, the expression vector is a baculovirus expression vector. Baculovirus vectors available for expression of proteins in cultured insect cells (e.g., Sf 9 cells) include the pAc series (Smith et al., 1983, *Mol. Cell Biol.* 3:2156-2165) and the pVL series (Lucklow and Summers, 1989, *Virology* 170:31-39).

In yet another embodiment, a nucleic acid of the present invention is expressed in mammalian cells using a mammalian expression vector. Examples of mammalian expression vectors include pCDM8 (Seed, 1987, *Nature* 329:840) and pMT2PC (Kaufman et al., 1987, *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al., 1987, *Genes Dev.* 1:268-277), lymphoid-specific promoters (Calame and Eaton, 1988, *Adv. Immunol.* 43:235-275), in particular promoters of T cell receptors (Winoto and Baltimore, 1989, *EMBO J.* 8:729-733) and immunoglobulins (Banerji et al., 1983, *Cell* 33:729-740; Queen and Baltimore, 1983, *Cell* 33:741-748), neuron-specific promoters (e.g., the neurofilament promoter; Byrne and Ruddle, 1989, *Proc. Natl. Acad. Sci. USA* 86:5473-5477), pancreas-specific promoters (Edlund et al., 1985, *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss, 1990, *Science* 249:374-379) and the α-fetoprotein promoter (Camper and Tilghman, 1989, *Genes Dev.* 3:537-546).

The present invention further provides a recombinant expression vector comprising a DNA molecule cloned into the expression vector in an antisense orientation. That is, the DNA molecule is operably linked to a regulatory sequence in a manner which allows for expression (by transcription of the DNA molecule) of an RNA molecule which is antisense to the mRNA encoding a polypeptide of the present invention. Regulatory sequences operably linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue-specific or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes (see Weintraub et al., 1986, *Trends in Genetics*, Vol. 1(1)).

Another aspect of the present invention pertains to host cells into which a recombinant expression vector of the present invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic (e.g., *E. coli*) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

V. Analyzing Biomarker Nucleic Acids and Polypeptides

Biomarker nucleic acids and/or biomarker polypeptides can be analyzed according to the methods described herein and techniques known to the skilled artisan to identify such genetic or expression alterations useful for the present invention including, but not limited to, 1) an alteration in the level of a biomarker transcript or polypeptide, 2) a deletion or addition of one or more nucleotides from a biomarker gene, 4) a substitution of one or more nucleotides of a biomarker gene, 5) aberrant modification of a biomarker gene, such as an expression regulatory region, and the like.

a. Methods for Detection of Copy Number

Methods of evaluating the copy number of a biomarker nucleic acid are well known to those of skill in the art. The presence or absence of chromosomal gain or loss can be evaluated simply by a determination of copy number of the regions or markers identified herein.

In one embodiment, a biological sample is tested for the presence of copy number changes in genomic loci containing the genomic marker. A copy number of at least 3, 4, 5, 6, 7, 8, 9, or 10 is predictive of poorer outcome of SFKSP treatment. In one embodiment, a biological sample is tested for the presence of copy number changes in genomic loci containing the genomic marker. The absence of at least one biomarker listed in Table 1 is predictive of poorer outcome of endocrine therapy. A copy number of at least 3, 4, 5, 6, 7, 8, 9, or 10 of at least one biomarker listed in Table 1 is predictive of likely responsive to endocrine therapy. A copy number of at least 3, 4, 5, 6, 7, 8, 9, or 10 of at least one biomarker listed in Table 2 is predictive of poorer outcome of endocrine therapy.

Methods of evaluating the copy number of a biomarker locus include, but are not limited to, hybridization-based assays. Hybridization-based assays include, but are not limited to, traditional "direct probe" methods, such as Southern blots, in situ hybridization (e.g., FISH and FISH plus SKY) methods, and "comparative probe" methods, such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In one embodiment, evaluating the biomarker gene copy number in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid. Alternatively, a Northern blot may be utilized for evaluating the copy number of encoding nucleic acid in a sample. In a Northern blot, mRNA is hybridized to a probe specific for the target region. Comparison of the intensity of the hybridization signal from the probe for the target region with control probe signal from analysis of normal RNA (e.g., a non-amplified portion of the same or related cell, tissue, organ, etc.) provides an estimate of the relative copy number of the target nucleic acid. Alternatively, other methods well known in the art to detect RNA can be used, such that higher or lower expression relative to an appropriate control (e.g., a non-amplified portion of the same or related cell tissue, organ, etc.) provides an estimate of the relative copy number of the target nucleic acid.

An alternative means for determining genomic copy number is in situ hybridization (e.g., Angerer (1987) Meth. Enzymol 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application. In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained. The probes are typically labeled, e.g., with radioisotopes or fluorescent reporters. In one embodiment, probes are sufficiently long so as to specifically hybridize with the target nucleic acid(s) under stringent conditions. Probes generally range in length from about 200 bases to about 1000 bases. In some applications it is necessary to block the hybridization capacity of repetitive sequences. Thus, in some embodiments, tRNA, human genomic DNA, or Cot-I DNA is used to block non-specific hybridization.

An alternative means for determining genomic copy number is comparative genomic hybridization. In general, genomic DNA is isolated from normal reference cells, as well as from test cells (e.g., tumor cells) and amplified, if necessary. The two nucleic acids are differentially labeled and then hybridized in situ to metaphase chromosomes of a reference cell. The repetitive sequences in both the reference and test DNAs are either removed or their hybridization capacity is reduced by some means, for example by prehybridization with appropriate blocking nucleic acids and/or including such blocking nucleic acid sequences for said repetitive sequences during said hybridization. The bound, labeled DNA sequences are then rendered in a visualizable form, if necessary. Chromosomal regions in the test cells which are at increased or decreased copy number can be identified by detecting regions where the ratio of signal from the two DNAs is altered. For example, those regions that have decreased in copy number in the test cells will show relatively lower signal from the test DNA than the reference compared to other regions of the genome. Regions that have been increased in copy number in the test cells will show relatively higher signal from the test DNA. Where there are chromosomal deletions or multiplications, differences in the ratio of the signals from the two labels will be detected and the ratio will provide a measure of the copy number. In another embodiment of CGH, array CGH (aCGH), the immobilized chromosome element is replaced with a collection of solid support bound target nucleic acids on an array, allowing for a large or complete percentage of the genome to be represented in the collection of solid support bound targets. Target nucleic acids may comprise cDNAs, genomic DNAs, oligonucleotides (e.g., to detect single nucleotide polymorphisms) and the like. Array-based CGH may also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Methods of preparing immobilized chromosomes or arrays and performing comparative genomic hybridization are well known in the art (see, e.g., U.S. Pat. Nos. 6,335,167; 6,197,501; 5,830,645; and 5,665,549 and Albertson (1984) EMBO J. 3: 1227-1234; Pinkel (1988) Proc. Natl. Acad. Sci. USA 85: 9138-9142; EPO Pub. No. 430,402; Methods in Molecular Biology, Vol. 33: In situ Hybridization Protocols, Choo, ed., Humana Press, Totowa, N.J. (1994), etc.) In another embodiment, the hybridization protocol of Pinkel, et al. (1998) *Nature Genetics* 20: 207-211, or of Kallioniemi (1992) *Proc. Natl Acad Sci USA* 89:5321-5325 (1992) is used.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis, et al. (1990) *PCR Protocols, A Guide to Methods and Applications*, Academic Press, Inc. N.Y.). Measurement of DNA copy number at microsatellite loci using quantitative PCR analysis is described in Ginzonger, et al. (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods of the present invention. In fluorogenic quantitative PCR, quantitation is based on amount of fluorescence signals, e.g., TaqMan and SYBR green.

Other suitable amplification methods include, but are not limited to, ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc.

Loss of heterozygosity (LOH) and major copy proportion (MCP) mapping (Wang, Z. C., et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93; Li et al., (2008) *MBC Bioinform.* 9, 204-219) may also be used to identify regions of amplification or deletion.

b. Methods for Detection of Biomarker Nucleic Acid Expression

Biomarker expression may be assessed by any of a wide variety of well known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

In another embodiment, detecting or determining expression levels of a biomarker and functionally similar homologs thereof, including a fragment or genetic alteration thereof (e.g., in regulatory or promoter regions thereof) comprises detecting or determining RNA levels for the marker of interest. In one embodiment, one or more cells from the subject to be tested are obtained and RNA is isolated from the cells. In a preferred embodiment, a sample of breast tissue cells is obtained from the subject.

In one embodiment, RNA is obtained from a single cell. For example, a cell can be isolated from a tissue sample by laser capture microdissection (LCM). Using this technique, a cell can be isolated from a tissue section, including a stained tissue section, thereby assuring that the desired cell is isolated (see, e.g., Bonner et al. (1997) *Science* 278: 1481; Emmert-Buck et al. (1996) *Science* 274:998; Fend et al. (1999) *Am. J. Path.* 154: 61 and Murakami et al. (2000) *Kidney Int.* 58:1346). For example, Murakami et al., supra, describe isolation of a cell from a previously immunostained tissue section.

It is also be possible to obtain cells from a subject and culture the cells in vitro, such as to obtain a larger population of cells from which RNA can be extracted. Methods for establishing cultures of non-transformed cells, i.e., primary cell cultures, are known in the art.

When isolating RNA from tissue samples or cells from individuals, it may be important to prevent any further changes in gene expression after the tissue or cells has been removed from the subject. Changes in expression levels are known to change rapidly following perturbations, e.g., heat shock or activation with lipopolysaccharide (LPS) or other reagents. In addition, the RNA in the tissue and cells may quickly become degraded. Accordingly, in a preferred embodiment, the tissue or cells obtained from a subject is snap frozen as soon as possible.

RNA can be extracted from the tissue sample by a variety of methods, e.g., the guanidium thiocyanate lysis followed by CsCl centrifugation (Chirgwin et al., 1979, Biochemistry 18:5294-5299). RNA from single cells can be obtained as described in methods for preparing cDNA libraries from single cells, such as those described in Dulac, C. (1998) *Curr. Top. Dev. Biol.* 36, 245 and Jena et al. (1996) *J. Immunol. Methods* 190:199. Care to avoid RNA degradation must be taken, e.g., by inclusion of RNAsin.

The RNA sample can then be enriched in particular species. In one embodiment, poly(A)+ RNA is isolated from the RNA sample. In general, such purification takes advantage of the poly-A tails on mRNA. In particular and as noted above, poly-T oligonucleotides may be immobilized within on a solid support to serve as affinity ligands for mRNA. Kits for this purpose are commercially available, e.g., the MessageMaker kit (Life Technologies, Grand Island, N.Y.).

In a preferred embodiment, the RNA population is enriched in marker sequences. Enrichment can be undertaken, e.g., by primer-specific cDNA synthesis, or multiple rounds of linear amplification based on cDNA synthesis and template-directed in vitro transcription (see, e.g., Wang et al. (1989) *PNAS* 86, 9717; Dulac et al., supra, and Jena et al., supra).

The population of RNA, enriched or not in particular species or sequences, can further be amplified. As defined herein, an "amplification process" is designed to strengthen, increase, or augment a molecule within the RNA. For example, where RNA is mRNA, an amplification process such as RT-PCR can be utilized to amplify the mRNA, such that a signal is detectable or detection is enhanced. Such an amplification process is beneficial particularly when the biological, tissue, or tumor sample is of a small size or volume.

Various amplification and detection methods can be used. For example, it is within the scope of the present invention to reverse transcribe mRNA into cDNA followed by polymerase chain reaction (RT-PCR); or, to use a single enzyme for both steps as described in U.S. Pat. No. 5,322,770, or reverse transcribe mRNA into cDNA followed by symmetric gap ligase chain reaction (RT-AGLCR) as described by R. L. Marshall, et al., PCR Methods and Applications 4: 80-84 (1994). Real time PCR may also be used.

Other known amplification methods which can be utilized herein include but are not limited to the so-called "NASBA" or "3SR" technique described in PNAS USA 87: 1874-1878 (1990) and also described in Nature 350 (No. 6313): 91-92 (1991); Q-beta amplification as described in published European Patent Application (EPA) No. 4544610; strand displacement amplification (as described in G. T. Walker et al., Clin. Chem. 42: 9-13 (1996) and European Patent Application No. 684315; target mediated amplification, as described by PCT Publication WO9322461; PCR; ligase chain reaction (LCR) (see, e.g., Wu and Wallace, Genomics 4, 560 (1989), Landegren et al., Science 241, 1077 (1988)); self-sustained sequence replication (SSR) (see, e.g., Guatelli et al., Proc. Nat. Acad. Sci. USA, 87, 1874 (1990)); and transcription amplification (see, e.g., Kwoh et al., Proc. Natl. Acad. Sci. USA 86, 1173 (1989)).

Many techniques are known in the state of the art for determining absolute and relative levels of gene expression, commonly used techniques suitable for use in the present invention include Northern analysis, RNase protection assays (RPA), microarrays and PCR-based techniques, such as quantitative PCR and differential display PCR. For example, Northern blotting involves running a preparation of RNA on a denaturing agarose gel, and transferring it to a suitable support, such as activated cellulose, nitrocellulose or glass or nylon membranes. Radiolabeled cDNA or RNA is then hybridized to the preparation, washed and analyzed by autoradiography.

In situ hybridization visualization may also be employed, wherein a radioactively labeled antisense RNA probe is hybridized with a thin section of a biopsy sample, washed, cleaved with RNase and exposed to a sensitive emulsion for autoradiography. The samples may be stained with hematoxylin to demonstrate the histological composition of the sample, and dark field imaging with a suitable light filter shows the developed emulsion. Non-radioactive labels such as digoxigenin may also be used.

Alternatively, mRNA expression can be detected on a DNA array, chip or a microarray. Labeled nucleic acids of a test sample obtained from a subject may be hybridized to a solid surface comprising biomarker DNA. Positive hybridization signal is obtained with the sample containing biomarker transcripts. Methods of preparing DNA arrays and their use are well known in the art (see, e.g., U.S. Pat. Nos. 6,618,6796; 6,379,897; 6,664,377; 6,451,536; 548,257; U.S. 20030157485 and Schena et al. (1995) Science 20, 467-470; Gerhold et al. (1999) Trends In Biochem. Sci. 24, 168-173; and Lennon et al. (2000) Drug Discovery Today 5, 59-65, which are herein incorporated by reference in their entirety).

Serial Analysis of Gene Expression (SAGE) can also be performed (See for example U.S. Patent Application 20030215858).

To monitor mRNA levels, for example, mRNA is extracted from the biological sample to be tested, reverse transcribed, and fluorescently-labeled cDNA probes are generated. The microarrays capable of hybridizing to marker cDNA are then probed with the labeled cDNA probes, the slides scanned and fluorescence intensity measured. This intensity correlates with the hybridization intensity and expression levels.

Types of probes that can be used in the methods described herein include cDNA, riboprobes, synthetic oligonucleotides and genomic probes. The type of probe used will generally be dictated by the particular situation, such as riboprobes for in situ hybridization, and cDNA for Northern blotting, for example. In one embodiment, the probe is directed to nucleotide regions unique to the RNA. The probes may be as short as is required to differentially recognize marker mRNA transcripts, and may be as short as, for example, 15 bases; however, probes of at least 17, 18, 19 or 20 or more bases can be used. In one embodiment, the primers and probes hybridize specifically under stringent conditions to a DNA fragment having the nucleotide sequence corresponding to the marker. As herein used, the term "stringent conditions" means hybridization will occur only if there is at least 95% identity in nucleotide sequences. In another embodiment, hybridization under "stringent conditions" occurs when there is at least 97% identity between the sequences.

The form of labeling of the probes may be any that is appropriate, such as the use of radioisotopes, for example, $^{32}P$ and $^{35}S$. Labeling with radioisotopes may be achieved, whether the probe is synthesized chemically or biologically, by the use of suitably labeled bases.

In one embodiment, the biological sample contains polypeptide molecules from the test subject. Alternatively, the biological sample can contain mRNA molecules from the test subject or genomic DNA molecules from the test subject.

In another embodiment, the methods further involve obtaining a control biological sample from a control subject, contacting the control sample with a compound or agent capable of detecting marker polypeptide, mRNA, genomic DNA, or fragments thereof, such that the presence of the marker polypeptide, mRNA, genomic DNA, or fragments thereof, is detected in the biological sample, and comparing the presence of the marker polypeptide, mRNA, genomic DNA, or fragments thereof, in the control sample with the presence of the marker polypeptide, mRNA, genomic DNA, or fragments thereof in the test sample.

c. Methods for Detection of Biomarker Protein Expression

The activity or level of a biomarker protein can be detected and/or quantified by detecting or quantifying the expressed polypeptide. The polypeptide can be detected and quantified by any of a number of means well known to those of skill in the art. Aberrant levels of polypeptide expression of the polypeptides encoded by a biomarker nucleic acid and functionally similar homologs thereof, including a fragment or genetic alteration thereof (e.g., in regulatory or promoter regions thereof) are associated with the likelihood of response of a cancer to SFKSP therapy. Any method known in the art for detecting polypeptides can be used. Such methods include, but are not limited to, immunodiffusion, immunoelectrophoresis, radioimmunoassay (RIA), enzyme-linked immunosorbent assays (ELISAs), immunofluorescent assays, Western blotting, binder-ligand assays, immunohistochemical techniques, agglutination, complement assays, high performance liquid chromatography (HPLC), thin layer chromatography (TLC), hyperdiffusion chromatography, and the like (e.g., Basic and Clinical Immunology, Sites and Terr, eds., Appleton and Lange, Norwalk, Conn. pp 217-262, 1991 which is incorporated by reference). Preferred are binder-ligand immunoassay methods including reacting antibodies with an epitope or epitopes and competitively displacing a labeled polypeptide or derivative thereof.

For example, ELISA and RIA procedures may be conducted such that a desired biomarker protein standard is labeled (with a radioisotope such as $^{125}$I or $^{35}$S, or an assayable enzyme, such as horseradish peroxidase or alkaline phosphatase), and, together with the unlabelled sample, brought into contact with the corresponding antibody, whereon a second antibody is used to bind the first, and radioactivity or the immobilized enzyme assayed (competitive assay). Alternatively, the biomarker protein in the sample is allowed to react with the corresponding immobilized antibody, radioisotope- or enzyme-labeled anti-biomarker proteinantibody is allowed to react with the system, and radioactivity or the enzyme assayed (ELISA-sandwich assay). Other conventional methods may also be employed as suitable.

The above techniques may be conducted essentially as a "one-step" or "two-step" assay. A "one-step" assay involves contacting antigen with immobilized antibody and, without washing, contacting the mixture with labeled antibody. A "two-step" assay involves washing before contacting, the mixture with labeled antibody. Other conventional methods may also be employed as suitable.

In one embodiment, a method for measuring biomarker protein levels comprises the steps of: contacting a biological specimen with an antibody or variant (e.g., fragment) thereof which selectively binds the biomarker protein, and detecting whether said antibody or variant thereof is bound to said sample and thereby measuring the levels of the biomarker protein.

Enzymatic and radiolabeling of biomarker protein and/or the antibodies may be effected by conventional means. Such means will generally include covalent linking of the enzyme to the antigen or the antibody in question, such as by glutaraldehyde, specifically so as not to adversely affect the activity of the enzyme, by which is meant that the enzyme must still be capable of interacting with its substrate, although it is not necessary for all of the enzyme to be active, provided that enough remains active to permit the assay to be effected. Indeed, some techniques for binding enzyme are non-specific (such as using formaldehyde), and will only yield a proportion of active enzyme.

It is usually desirable to immobilize one component of the assay system on a support, thereby allowing other components of the system to be brought into contact with the component and readily removed without laborious and time-consuming labor. It is possible for a second phase to be immobilized away from the first, but one phase is usually sufficient.

It is possible to immobilize the enzyme itself on a support, but if solid-phase enzyme is required, then this is generally best achieved by binding to antibody and affixing the antibody to a support, models and systems for which are well-known in the art. Simple polyethylene may provide a suitable support.

Enzymes employable for labeling are not particularly limited, but may be selected from the members of the oxidase group, for example. These catalyze production of hydrogen peroxide by reaction with their substrates, and glucose oxidase is often used for its good stability, ease of availability and cheapness, as well as the ready availability of its substrate (glucose). Activity of the oxidase may be assayed by measuring the concentration of hydrogen peroxide formed after reaction of the enzyme-labeled antibody with the substrate under controlled conditions well-known in the art.

Other techniques may be used to detect biomarker protein according to a practitioner's preference based upon the present disclosure. One such technique is Western blotting (Towbin et al., Proc. Nat. Acad. Sci. 76:4350 (1979)), wherein a suitably treated sample is run on an SDS-PAGE gel before being transferred to a solid support, such as a nitrocellulose filter. Anti-biomarker protein antibodies (unlabeled) are then brought into contact with the support and assayed by a secondary immunological reagent, such as labeled protein A or anti-immunoglobulin (suitable labels including $^{125}$I, horseradish peroxidase and alkaline phosphatase). Chromatographic detection may also be used.

Immunohistochemistry may be used to detect expression of biomarker protein, e.g., in a biopsy sample. A suitable antibody is brought into contact with, for example, a thin layer of cells, washed, and then contacted with a second, labeled antibody. Labeling may be by fluorescent markers, enzymes, such as peroxidase, avidin, or radiolabelling. The assay is scored visually, using microscopy.

Anti-biomarker protein antibodies, such as intrabodies, may also be used for imaging purposes, for example, to detect the presence of biomarker protein in cells and tissues of a subject. Suitable labels include radioisotopes, iodine ($^{125}$I, $^{121}$I), carbon ($^{14}$C), sulphur ($^{35}$S), tritium ($^{3}$H), indium ($^{112}$In), and technetium ($^{99}$mTc), fluorescent labels, such as fluorescein and rhodamine, and biotin.

For in vivo imaging purposes, antibodies are not detectable, as such, from outside the body, and so must be labeled, or otherwise modified, to permit detection. Markers for this purpose may be any that do not substantially interfere with the antibody binding, but which allow external detection. Suitable markers may include those that may be detected by X-radiography, NMR or MRI. For X-radiographic techniques, suitable markers include any radioisotope that emits detectable radiation but that is not overtly harmful to the subject, such as barium or cesium, for example. Suitable markers for NMR and MRI generally include those with a detectable characteristic spin, such as deuterium, which may be incorporated into the antibody by suitable labeling of nutrients for the relevant hybridoma, for example.

The size of the subject, and the imaging system used, will determine the quantity of imaging moiety needed to produce diagnostic images. In the case of a radioisotope moiety, for a human subject, the quantity of radioactivity injected will normally range from about 5 to 20 millicuries of technetium-99. The labeled antibody or antibody fragment will then preferentially accumulate at the location of cells which contain biomarker protein. The labeled antibody or antibody fragment can then be detected using known techniques.

Antibodies that may be used to detect biomarker protein include any antibody, whether natural or synthetic, full length or a fragment thereof, monoclonal or polyclonal, that binds sufficiently strongly and specifically to the biomarker protein to be detected. An antibody may have a $K_d$ of at most about $10^{-6}$M, $10^{-7}$M, $10^{-8}$M, $10^{-9}$M, $10^{-10}$M, $10^{-11}$M, $10^{-12}$M. The phrase "specifically binds" refers to binding of, for example, an antibody to an epitope or antigen or antigenic determinant in such a manner that binding can be displaced or competed with a second preparation of identical or similar epitope, antigen or antigenic determinant. An antibody may bind preferentially to the biomarker protein relative to other proteins, such as related proteins.

Antibodies are commercially available or may be prepared according to methods known in the art.

Antibodies and derivatives thereof that may be used encompass polyclonal or monoclonal antibodies, chimeric, human, humanized, primatized (CDR-grafted), veneered or single-chain antibodies as well as functional fragments, i.e., biomarker protein binding fragments, of antibodies. For example, antibody fragments capable of binding to a biomarker protein or portions thereof, including, but not limited to, Fv, Fab, Fab' and F(ab') 2 fragments can be used. Such fragments can be produced by enzymatic cleavage or by recombinant techniques. For example, papain or pepsin cleavage can generate Fab or F(ab') 2 fragments, respectively. Other proteases with the requisite substrate specificity can also be used to generate Fab or F(ab') 2 fragments. Antibodies can also be produced in a variety of truncated forms using antibody genes in which one or more stop codons have been introduced upstream of the natural stop site. For example, a chimeric gene encoding a F(ab') 2 heavy chain portion can be designed to include DNA sequences encoding the CH, domain and hinge region of the heavy chain.

Synthetic and engineered antibodies are described in, e.g., Cabilly et al., U.S. Pat. No. 4,816,567 Cabilly et al., European Patent No. 0,125,023 B1; Boss et al., U.S. Pat. No. 4,816,397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Queen et al., European Patent No. 0451216 B1; and Padlan, E. A. et al., EP 0519596 A1. See also, Newman, R. et al., BioTechnology, 10: 1455-1460 (1992), regarding primatized antibody, and Ladner et al., U.S. Pat. No. 4,946,778 and Bird, R. E. et al., Science, 242: 423-426 (1988)) regarding single-chain antibodies. Antibodies produced from a library, e.g., phage display library, may also be used.

In some embodiments, agents that specifically bind to a biomarker protein other than antibodies are used, such as peptides. Peptides that specifically bind to a biomarker protein can be identified by any means known in the art. For example, specific peptide binders of a biomarker protein can be screened for using peptide phage display libraries.

d. Methods for Detection of Biomarker Structural Alterations

The following illustrative methods can be used to identify the presence of a structural alteration in a biomarker nucleic acid and/or biomarker polypeptide molecule in order to, for example, identify PAK2, CRK, and/or SFK proteins that are both overexpressed and functional.

The following illustrative methods can be used to identify the presence of a structural alteration in a biomarker nucleic acid and/or biomarker polypeptide molecule in order to, for example, identify SFKSP pathway proteins that are overexpressed, overfunctional, and the like.

In certain embodiments, detection of the alteration involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) Science 241:1077-1080; and Nakazawa et al. (1994) Proc. Natl. Acad. Sci. USA 91:360-364), the latter of which can be particularly useful for detecting point mutations in a biomarker nucleic acid such as a biomarker gene (see Abravaya et al. (1995) Nucleic Acids Res. 23:675-682). This method can include the steps of collecting a sample of cells from a subject, isolating nucleic acid (e.g., genomic, mRNA or both) from the cells of the sample, contacting the nucleic acid sample with one or more primers which specifically hybridize to a biomarker gene under conditions such that hybridization and amplification of the biomarker gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al. (1990) Proc. Natl. Acad. Sci. USA 87:1874-1878), transcriptional amplification system (Kwoh, D. Y. et al. (1989) Proc. Natl. Acad. Sci. USA 86:1173-1177), Q-Beta Replicase (Lizardi, P. M. et al. (1988) Bio-Technology 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a biomarker nucleic acid from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in biomarker nucleic acid can be identified by hybridizing a sample and control nucleic acids, e.g., DNA or RNA, to high density arrays containing hundreds or thousands of oligonucleotide probes (Cronin, M. T. et al. (1996) Hum. Mutat. 7:244-255; Kozal, M. J. et al. (1996) Nat. Med. 2:753-759). For example, biomarker genetic mutations can be identified in two dimensional arrays containing light-generated DNA probes as described in Cronin et al. (1996) supra. Briefly, a first hybridization array of probes can be used to scan through long stretches of DNA in a sample and control to identify base changes between the sequences by making linear arrays of sequential, overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene. Such biomarker genetic mutations can be identified in a variety of contexts, including, for example, germline and somatic mutations.

In yet another embodiment, any of a variety of sequencing reactions known in the art can be used to directly sequence a biomarker gene and detect mutations by comparing the sequence of the sample biomarker with the corresponding wild-type (control) sequence. Examples of sequencing reactions include those based on techniques developed by Maxam and Gilbert (1977) *Proc. Natl. Acad. Sci. USA* 74:560 or Sanger (1977) *Proc. Natl. Acad Sci. USA* 74:5463.

It is also contemplated that any of a variety of automated sequencing procedures can be utilized when performing the diagnostic assays (Naeve (1995) *Biotechniques* 19:448-53), including sequencing by mass spectrometry (see, e.g., PCT International Publication No. WO 94/16101; Cohen et al. (1996) *Adv. Chromatogr.* 36:127-162; and Griffin et al. (1993) *Appl. Biochem. Biotechnol.* 38:147-159).

Other methods for detecting mutations in a biomarker gene include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes formed by hybridizing (labeled) RNA or DNA containing the wild-type biomarker sequence with potentially mutant RNA or DNA obtained from a tissue sample. The double-stranded duplexes are treated with an agent which cleaves single-stranded regions of the duplex such as which will exist due to base pair mismatches between the control and sample strands. For instance, RNA/DNA duplexes can be treated with RNase and DNA/DNA hybrids treated with SI nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl. Acad. Sci. USA* 85:4397 and Saleeba et al. (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in biomarker cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a biomarker sequence, e.g., a wild-type biomarker treated with a DNA mismatch repair enzyme, and the cleavage products, if any, can be detected from electrophoresis protocols or the like (e.g., U.S. Pat. No. 5,459,039.)

In other embodiments, alterations in electrophoretic mobility can be used to identify mutations in biomarker genes. For example, single strand conformation polymorphism (SSCP) may be used to detect differences in electrophoretic mobility between mutant and wild type nucleic acids (Orita et al. (1989) *Proc Natl. Acad. Sci USA* 86:2766; see also Cotton (1993) *Mutat. Res.* 285:125-144 and Hayashi (1992) *Genet. Anal. Tech. Appl.* 9:73-79). Single-stranded DNA fragments of sample and control biomarker nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to ensure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys. Chem.* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163; Saiki et al. (1989) *Proc. Natl. Acad. Sci. USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6:1). It is anticipated that in certain embodiments amplification may also be performed using Taq ligase for amplification (Barany (1991) *Proc. Natl. Acad. Sci USA* 88:189). In such cases, ligation will occur only if there is a perfect match at the 3' end of the 5' sequence making it possible to detect the presence of a known mutation at a specific site by looking for the presence or absence of amplification.

3. Anti-Cancer Therapies

The efficacy of SFKSP therapy is predicted according to biomarker amount and/or activity associated with a cancer in a subject according to the methods described herein. In one embodiment, such SFKSP therapy or combinations of therapies (e.g., one or more SFKSP inhibitors in combination with one or more additional CSK activators) can be administered once a subject is indicated as being a likely responder to a SFKSP inhibitor. In another embodiment, such SFKSP therapy can be avoided once a subject is indicated as not being a likely responder to a PD-1 pathway inhibitor and an alternative treatment regimen, such as targeted and/or untargeted anti-cancer therapies can be administered. Combination therapies are also contemplated and can comprise, for example, one or more chemotherapeutic agents and radiation, one or more chemotherapeutic agents and immunotherapy, or one or more chemotherapeutic agents, radiation and chemotherapy, each combination of which can be with SFKSP therapy. The SFKSP and exemplary agents useful for inhibiting the SFKSP, or other biomarkers described herein, have been described above.

The iron-sulfur cluster biosynthesis pathway and exemplary agents useful for inhibiting the iron-sulfur cluster biosynthesis pathway, or other biomarkers described herein, have been described above.

The term "targeted therapy" refers to administration of agents that selectively interact with a chosen biomolecule to thereby treat cancer. For example, SFKSP pathway agents, such as therapeutic monoclonal or polyclonal blocking antibodies or small molecule inhibitors (e.g., Dastinib, Saracatinib, FRAX597 and the like), can be used to target tumor microenvironments and cells expressing unwanted components of the SFKSP pathway, such as PAK2 or CRK.

Immunotherapy is one form of targeted therapy that may comprise, for example, the use of cancer vaccines and/or sensitized antigen presenting cells. For example, an oncolytic virus is a virus that is able to infect and lyse cancer cells, while leaving normal cells unharmed, making them potentially useful in cancer therapy. Replication of oncolytic viruses both facilitates tumor cell destruction and also produces dose amplification at the tumor site. They may also act as vectors for anticancer genes, allowing them to be specifically delivered to the tumor site. The immunotherapy can involve passive immunity for short-term protection of a host, achieved by the administration of pre-formed antibody directed against a cancer antigen or disease antigen (e.g., administration of a monoclonal antibody, optionally linked to a chemotherapeutic agent or toxin, to a tumor antigen). Immunotherapy can also focus on using the cytotoxic lymphocyte-recognized epitopes of cancer cell lines. Alternatively, antisense polynucleotides, ribozymes, RNA interference molecules, triple helix polynucleotides and the like, can be used to selectively modulate biomolecules that are linked to the initiation, progression, and/or pathology of a tumor or cancer.

The term "untargeted therapy" referes to administration of agents that do not selectively interact with a chosen biomolecule yet treat cancer. Representative examples of untargeted therapies include, without limitation, chemotherapy, gene therapy, and radiation therapy.

In one embodiment, mitochondrial cofactor therapy is useful. For example, vitamin E is known to block cell death via ferroptosis such that mitochondrial cofactor therapy can alleviate or improve any toxicity associated with ISC biosynthesis pathway inhibition. Mitochondrial cofactor therapies are well known in the art and include, for example, coenzyme Q10 (ubiquinone), riboflavin, thiamin, niacin, vitamin K (phylloquinone and menadione), creatine, carnitine, and other antioxidants such as ascorbic acid and lipoic acid (see, for example, Marriage et al. (2003) *J. Am. Diet. Assoc.* 103:1029-1038 and Parikh et al. (2009) *Curr. Treat. Options Neurol.* 11:414-430).

In one embodiment, chemotherapy is used. Chemotherapy includes the administration of a chemotherapeutic agent. Such a chemotherapeutic agent may be, but is not limited to, those selected from among the following groups of compounds: platinum compounds, cytotoxic antibiotics, antimetabolities, anti-mitotic agents, alkylating agents, arsenic compounds, DNA topoisomerase inhibitors, taxanes, nucleoside analogues, plant alkaloids, and toxins; and synthetic derivatives thereof. Exemplary compounds include, but are not limited to, alkylating agents: cisplatin, treosulfan, and trofosfamide; plant alkaloids: vinblastine, paclitaxel, docetaxol; DNA topoisomerase inhibitors: teniposide, crisnatol, and mitomycin; anti-folates: methotrexate, mycophenolic acid, and hydroxyurea; pyrimidine analogs: 5-fluorouracil, doxifluridine, and cytosine arabinoside; purine analogs: mercaptopurine and thioguanine; DNA antimetabolites: 2'-deoxy-5-fluorouridine, aphidicolin glycinate, and pyrazoloimidazole; and antimitotic agents: halichondrin, colchicine, and rhizoxin. Compositions comprising one or more chemotherapeutic agents (e.g., FLAG, CHOP) may also be used. FLAG comprises fludarabine, cytosine arabinoside (Ara-C) and G-CSF. CHOP comprises cyclophosphamide, vincristine, doxorubicin, and prednisone. In another embodiments, PARP (e.g., PARP-1 and/or PARP-2) inhibitors are used and such inhibitors are well known in the art (e.g., Olaparib, ABT-888, BSI-201, BGP-15 (N-Gene Research Laboratories, Inc.); INO-1001 (Inotek Pharmaceuticals Inc.); PJ34 (Soriano et al., 2001; Pacher et al., 2002b); 3-aminobenzamide (Trevigen); 4-amino-1,8-naphthalimide; (Trevigen); 6(5H)-phenanthridinone (Trevigen); benzamide (U.S. Pat. No. Re. 36,397); and NU1025 (Bowman et al.). The mechanism of action is generally related to the ability of PARP inhibitors to bind PARP and decrease its activity. PARP catalyzes the conversion of β-nicotinamide adenine dinucleotide (NAD+) into nicotinamide and poly-ADP-ribose (PAR). Both poly (ADP-ribose) and PARP have been linked to regulation of transcription, cell proliferation, genomic stability, and carcinogenesis (Bouchard V. J. et. al. Experimental Hematology, Volume 31, Number 6, June 2003, pp. 446-454(9); Herceg Z.; Wang Z.-Q. Mutation Research/Fundamental and Molecular Mechanisms of Mutagenesis, Volume 477, Number 1, 2 Jun. 2001, pp. 97-110(14)). Poly(ADP-ribose) polymerase 1 (PARP1) is a key molecule in the repair of DNA single-strand breaks (SSBs) (de Murcia J. et al. 1997. Proc Natl Acad Sci USA 94:7303-7307; Schreiber V, Dantzer F, Ame J C, de Murcia G (2006) Nat Rev Mol Cell Biol 7:517-528; Wang Z Q, et al. (1997) Genes Dev 11:2347-2358). Knockout of SSB repair by inhibition of PARP1 function induces DNA double-strand breaks (DSBs) that can trigger synthetic lethality in cancer cells with defective homology-directed DSB repair (Bryant H E, et al. (2005) Nature 434:913-917; Farmer H, et al. (2005) Nature 434:917-921). The foregoing examples of chemotherapeutic agents are illustrative, and are not intended to be limiting.

In another embodiment, radiation therapy is used. The radiation used in radiation therapy can be ionizing radiation. Radiation therapy can also be gamma rays, X-rays, or proton beams. Examples of radiation therapy include, but are not limited to, external-beam radiation therapy, interstitial implantation of radioisotopes (I-125, palladium, iridium), radioisotopes such as strontium-89, thoracic radiation therapy, intraperitoneal P-32 radiation therapy, and/or total abdominal and pelvic radiation therapy. For a general overview of radiation therapy, see Hellman, Chapter 16: Principles of Cancer Management: Radiation Therapy, 6th edition, 2001, DeVita et al., eds., J. B. Lippencott Company, Philadelphia. The radiation therapy can be administered as external beam radiation or teletherapy wherein the radiation is directed from a remote source. The radiation treatment can also be administered as internal therapy or brachytherapy wherein a radioactive source is placed inside the body close to cancer cells or a tumor mass. Also encompassed is the use of photodynamic therapy comprising the administration of photosensitizers, such as hematoporphyrin and its derivatives, Vertoporfin (BPD-MA), phthalocyanine, photosensitizer Pc4, demethoxy-hypocrellin A; and 2BA-2-DMHA.

In another embodiment, hormone therapy is used. Hormonal therapeutic treatments can comprise, for example, hormonal agonists, hormonal antagonists (e.g., flutamide, bicalutamide, tamoxifen, raloxifene, leuprolide acetate (LUPRON), LH-RH antagonists), inhibitors of hormone biosynthesis and processing, and steroids (e.g., dexamethasone, retinoids, deltoids, betamethasone, cortisol, cortisone, prednisone, dehydrotestosterone, glucocorticoids, mineralocorticoids, estrogen, testosterone, progestins), vitamin A derivatives (e.g., all-trans retinoic acid (ATRA)); vitamin D3 analogs; antigestagens (e.g., mifepristone, onapristone), or antiandrogens (e.g., cyproterone acetate).

In another embodiment, hyperthermia, a procedure in which body tissue is exposed to high temperatures (up to 106° F.) is used. Heat may help shrink tumors by damaging cells or depriving them of substances they need to live. Hyperthermia therapy can be local, regional, and whole-body hyperthermia, using external and internal heating devices. Hyperthermia is almost always used with other forms of therapy (e.g., radiation therapy, chemotherapy, and biological therapy) to try to increase their effectiveness. Local hyperthermia refers to heat that is applied to a very small area, such as a tumor. The area may be heated externally with high-frequency waves aimed at a tumor from a device outside the body. To achieve internal heating, one of several types of sterile probes may be used, including thin, heated wires or hollow tubes filled with warm water; implanted microwave antennae; and radiofrequency electrodes. In regional hyperthermia, an organ or a limb is heated. Magnets and devices that produce high energy are placed over the region to be heated. In another approach, called perfusion, some of the patient's blood is removed, heated, and then pumped (perfused) into the region that is to be heated internally. Whole-body heating is used to treat metastatic cancer that has spread throughout the body. It can be accomplished using warm-water blankets, hot wax, inductive coils (like those in electric blankets), or thermal chambers (similar to large incubators). Hyperthermia does not cause any marked increase in radiation side effects or complications. Heat applied directly to the skin, however, can cause discomfort or even significant local pain in about half the patients treated. It can also cause blisters, which generally heal rapidly.

In still another embodiment, photodynamic therapy (also called PDT, photoradiation therapy, phototherapy, or photochemotherapy) is used for the treatment of some types of cancer. It is based on the discovery that certain chemicals known as photosensitizing agents can kill one-celled organisms when the organisms are exposed to a particular type of light. PDT destroys cancer cells through the use of a fixed-frequency laser light in combination with a photosensitizing agent. In PDT, the photosensitizing agent is injected into the bloodstream and absorbed by cells all over the body. The agent remains in cancer cells for a longer time than it does in normal cells. When the treated cancer cells are exposed to laser light, the photosensitizing agent absorbs the light and produces an active form of oxygen that destroys the treated cancer cells. Light exposure must be timed carefully so that it occurs when most of the photosensitizing agent has left healthy cells but is still present in the cancer cells. The laser light used in PDT can be directed through a fiber-optic (a very thin glass strand). The fiber-optic is placed close to the cancer to deliver the proper amount of light. The fiber-optic can be directed through a bronchoscope into the lungs for the treatment of lung cancer or through an endoscope into the esophagus for the treatment of esophageal cancer. An advantage of PDT is that it causes minimal damage to healthy tissue. However, because the laser light currently in use cannot pass through more than about 3 centimeters of tissue (a little more than one and an eighth inch), PDT is mainly used to treat tumors on or just under the skin or on the lining of internal organs. Photodynamic therapy makes the skin and eyes sensitive to light for 6 weeks or more after treatment. Patients are advised to avoid direct sunlight and bright indoor light for at least 6 weeks. If patients must go outdoors, they need to wear protective clothing, including sunglasses. Other temporary side effects of PDT are related to the treatment of specific areas and can include coughing, trouble swallowing, abdominal pain, and painful breathing or shortness of breath. In December 1995, the U.S. Food and Drug Administration (FDA) approved a photosensitizing agent called porfimer sodium, or Photofrin®, to relieve symptoms of esophageal cancer that is causing an obstruction and for esophageal cancer that cannot be satisfactorily treated with lasers alone. In January 1998, the FDA approved porfimer sodium for the treatment of early nonsmall cell lung cancer in patients for whom the usual treatments for lung cancer are not appropriate. The National Cancer Institute and other institutions are supporting clinical trials (research studies) to evaluate the use of photodynamic therapy for several types of cancer, including cancers of the bladder, brain, larynx, and oral cavity.

In yet another embodiment, laser therapy is used to harness high-intensity light to destroy cancer cells. This technique is often used to relieve symptoms of cancer such as bleeding or obstruction, especially when the cancer cannot be cured by other treatments. It may also be used to treat cancer by shrinking or destroying tumors. The term "laser" stands for light amplification by stimulated emission of radiation. Ordinary light, such as that from a light bulb, has many wavelengths and spreads in all directions. Laser light, on the other hand, has a specific wavelength and is focused in a narrow beam. This type of high-intensity light contains a lot of energy. Lasers are very powerful and may be used to cut through steel or to shape diamonds. Lasers also can be used for very precise surgical work, such as repairing a damaged retina in the eye or cutting through tissue (in place of a scalpel). Although there are several different kinds of lasers, only three kinds have gained wide use in medicine: Carbon dioxide ($CO_2$) laser—This type of laser can remove thin layers from the skin's surface without penetrating the deeper layers. This technique is particularly useful in treating tumors that have not spread deep into the skin and certain precancerous conditions. As an alternative to traditional scalpel surgery, the $CO_2$ laser is also able to cut the skin. The laser is used in this way to remove skin cancers. Neodymium:yttrium-aluminum-garnet (Nd:YAG) laser—Light from this laser can penetrate deeper into tissue than light from the other types of lasers, and it can cause blood to clot quickly. It can be carried through optical fibers to less accessible parts of the body. This type of laser is sometimes used to treat throat cancers. Argon laser—This laser can pass through only superficial layers of tissue and is therefore useful in dermatology and in eye surgery. It also is used with light-sensitive dyes to treat tumors in a procedure known as photodynamic therapy (PDT). Lasers have several advantages over standard surgical tools, including: Lasers are more precise than scalpels. Tissue near an incision is protected, since there is little contact with surrounding skin or other tissue. The heat produced by lasers sterilizes the surgery site, thus reducing the risk of infection. Less operating time may be needed because the precision of the laser allows for a smaller incision. Healing time is often shortened; since laser heat seals blood vessels, there is less bleeding, swelling, or scarring. Laser surgery may be less complicated. For example, with fiber optics, laser light can be directed to parts of the body without making a large incision. More procedures may be done on an outpatient basis. Lasers can be used in two ways to treat cancer: by shrinking or destroying a tumor with heat, or by activating a chemical—known as a photosensitizing agent—that destroys cancer cells. In PDT, a photosensitizing agent is retained in cancer cells and can be stimulated by light to cause a reaction that kills cancer cells. $CO_2$ and Nd:YAG lasers are used to shrink or destroy tumors. They may be used with endoscopes, tubes that allow physicians to see into certain areas of the body, such as the bladder. The light from some lasers can be transmitted through a flexible endoscope fitted with fiber optics. This allows physicians to see and work in parts of the body that could not otherwise be reached except by surgery and therefore allows very precise aiming of the laser beam. Lasers also may be used with low-power microscopes, giving the doctor a clear view of the site being treated. Used with other instruments, laser systems can produce a cutting area as small as 200 microns in diameter— less than the width of a very fine thread. Lasers are used to treat many types of cancer. In addition to its use to destroy the cancer, laser surgery is also used to help relieve symptoms caused by cancer (palliative care). It is also sometimes used for palliation in colorectal and anal cancer. Laser-induced interstitial thermotherapy (LITT) is one of the most recent developments in laser therapy. LITT uses the same idea as a cancer treatment called hyperthermia; that heat may help shrink tumors by damaging cells or depriving them of substances they need to live. In this treatment, lasers are directed to interstitial areas (areas between organs) in the body. The laser light then raises the temperature of the tumor, which damages or destroys cancer cells.

The duration and/or dose of treatment with SFKSP therapies may vary according to the particular SFKSP agent or combination thereof. An appropriate treatment time for a particular cancer therapeutic agent will be appreciated by the skilled artisan. The present invention contemplates the continued assessment of optimal treatment schedules for each cancer therapeutic agent, where the phenotype of the cancer of the subject as determined by the methods of the present invention is a factor in determining optimal treatment doses and schedules.

Any means for the introduction of a polynucleotide into mammals, human or non-human, or cells thereof may be adapted to the practice of this invention for the delivery of the various constructs of the present invention into the intended recipient. In one embodiment of the present invention, the DNA constructs are delivered to cells by transfection, i.e., by delivery of "naked" DNA or in a complex with a colloidal dispersion system. A colloidal system includes macromolecule complexes, nanocapsules, microspheres, beads, and lipid-based systems including oil-in-water emulsions, micelles, mixed micelles, and liposomes. The preferred colloidal system of this invention is a lipid-complexed or liposome-formulated DNA. In the former approach, prior to formulation of DNA, e.g., with lipid, a plasmid containing a transgene bearing the desired DNA constructs may first be experimentally optimized for expression (e.g., inclusion of an intron in the 5' untranslated region and elimination of unnecessary sequences (Feigner, et al., Ann NY Acad Sci 126-139, 1995). Formulation of DNA, e.g. with various lipid or liposome materials, may then be effected using known methods and materials and delivered to the recipient mammal. See, e.g., Canonico et al, Am J Respir Cell Mol Biol 10:24-29, 1994; Tsan et al, Am J Physiol 268; Alton et al., Nat Genet. 5:135-142, 1993 and U.S. Pat. No. 5,679,647 by Carson et al.

The targeting of liposomes can be classified based on anatomical and mechanistic factors. Anatomical classification is based on the level of selectivity, for example, organ-specific, cell-specific, and organelle-specific. Mechanistic targeting can be distinguished based upon whether it is passive or active. Passive targeting utilizes the natural tendency of liposomes to distribute to cells of the reticuloendothelial system (RES) in organs, which contain sinusoidal capillaries. Active targeting, on the other hand, involves alteration of the liposome by coupling the liposome to a specific ligand such as a monoclonal antibody, sugar, glycolipid, or protein, or by changing the composition or size of the liposome in order to achieve targeting to organs and cell types other than the naturally occurring sites of localization.

The surface of the targeted delivery system may be modified in a variety of ways. In the case of a liposomal targeted delivery system, lipid groups can be incorporated into the lipid bilayer of the liposome in order to maintain the targeting ligand in stable association with the liposomal bilayer. Various linking groups can be used for joining the lipid chains to the targeting ligand. Naked DNA or DNA associated with a delivery vehicle, e.g., liposomes, can be administered to several sites in a subject (see below).

Nucleic acids can be delivered in any desired vector. These include viral or non-viral vectors, including adenovirus vectors, adeno-associated virus vectors, retrovirus vectors, lentivirus vectors, and plasmid vectors. Exemplary types of viruses include HSV (herpes simplex virus), AAV (adeno associated virus), HIV (human immunodeficiency virus), BIV (bovine immunodeficiency virus), and MLV (murine leukemia virus). Nucleic acids can be administered in any desired format that provides sufficiently efficient delivery levels, including in virus particles, in liposomes, in nanoparticles, and complexed to polymers.

The nucleic acids encoding a protein or nucleic acid of interest may be in a plasmid or viral vector, or other vector as is known in the art. Such vectors are well known and any can be selected for a particular application. In one embodiment of the present invention, the gene delivery vehicle comprises a promoter and a demethylase coding sequence. Preferred promoters are tissue-specific promoters and promoters which are activated by cellular proliferation, such as the thymidine kinase and thymidylate synthase promoters. Other preferred promoters include promoters which are activatable by infection with a virus, such as the α- and β-interferon promoters, and promoters which are activatable by a hormone, such as estrogen. Other promoters which can be used include the Moloney virus LTR, the CMV promoter, and the mouse albumin promoter. A promoter may be constitutive or inducible.

In another embodiment, naked polynucleotide molecules are used as gene delivery vehicles, as described in WO 90/11092 and U.S. Pat. No. 5,580,859. Such gene delivery vehicles can be either growth factor DNA or RNA and, in certain embodiments, are linked to killed adenovirus. Curiel et al., Hum. Gene. Ther. 3:147-154, 1992. Other vehicles which can optionally be used include DNA-ligand (Wu et al., J. Biol. Chem. 264:16985-16987, 1989), lipid-DNA combinations (Feigner et al., Proc. Natl. Acad. Sci. USA 84:7413 7417, 1989), liposomes (Wang et al., Proc. Natl. Acad. Sci. 84:7851-7855, 1987) and microprojectiles (Williams et al., Proc. Natl. Acad. Sci. 88:2726-2730, 1991).

A gene delivery vehicle can optionally comprise viral sequences such as a viral origin of replication or packaging signal. These viral sequences can be selected from viruses such as astrovirus, coronavirus, orthomyxovirus, papovavirus, paramyxovirus, parvovirus, picornavirus, poxvirus, retrovirus, togavirus or adenovirus. In a preferred embodiment, the growth factor gene delivery vehicle is a recombinant retroviral vector. Recombinant retroviruses and various uses thereof have been described in numerous references including, for example, Mann et al., Cell 33:153, 1983, Cane and Mulligan, Proc. Nat'l. Acad. Sci. USA 81:6349, 1984, Miller et al., Human Gene Therapy 1:5-14, 1990, U.S. Pat. Nos. 4,405,712, 4,861,719, and 4,980,289, and PCT Application Nos. WO 89/02,468, WO 89/05,349, and WO 90/02,806. Numerous retroviral gene delivery vehicles can be utilized in the present invention, including for example those described in EP 0,415,731; WO 90/07936; WO 94/03622; WO 93/25698; WO 93/25234; U.S. Pat. No. 5,219,740; WO 9311230; WO 9310218; Vile and Hart, Cancer Res. 53:3860-3864, 1993; Vile and Hart, Cancer Res. 53:962-967, 1993; Ram et al., Cancer Res. 53:83-88, 1993; Takamiya et al., J. Neurosci. Res. 33:493-503, 1992; Baba et al., J. Neurosurg. 79:729-735, 1993 (U.S. Pat. No. 4,777,127, GB 2,200,651, EP 0,345,242 and WO91/02805).

Other viral vector systems that can be used to deliver a polynucleotide of the present invention have been derived from herpes virus, e.g., Herpes Simplex Virus (U.S. Pat. No. 5,631,236 by Woo et al., issued May 20, 1997 and WO 00/08191 by Neurovex), vaccinia virus (Ridgeway (1988) Ridgeway, "Mammalian expression vectors," In: Rodriguez R L, Denhardt D T, ed. Vectors: A survey of molecular cloning vectors and their uses. Stoneham: Butterworth; Baichwal and Sugden (1986) "Vectors for gene transfer derived from animal DNA viruses: Transient and stable expression of transferred genes," In: Kucherlapati R, ed. Gene transfer. New York: Plenum Press; Coupar et al. (1988) Gene, 68:1-10), and several RNA viruses. Preferred viruses include an alphavirus, a poxivirus, an arena virus, a vaccinia virus, a polio virus, and the like. They offer several attractive features for various mammalian cells (Friedmann (1989) Science, 244:1275-1281; Ridgeway, 1988, supra; Baichwal and Sugden, 1986, supra; Coupar et al., 1988; Horwich et al. (1990) J. Virol., 64:642-650).

In other embodiments, target DNA in the genome can be manipulated using well-known methods in the art. For example, the target DNA in the genome can be manipulated by deletion, insertion, and/or mutation are retroviral insertion, artificial chromosome techniques, gene insertion, random insertion with tissue specific promoters, gene targeting, transposable elements and/or any other method for introducing foreign DNA or producing modified DNA/modified nuclear DNA. Other modification techniques include deleting DNA sequences from a genome and/or altering nuclear DNA sequences. Nuclear DNA sequences, for example, may be altered by site-directed mutagenesis.

In other embodiments, recombinant biomarker polypeptides, and fragments thereof, can be administered to subjects. In some embodiments, fusion proteins can be constructed and administered which have enhanced biological properties. In addition, the biomarker polypeptides, and fragment thereof, can be modified according to well-known pharmacological methods in the art (e.g., pegylation, glycosylation, oligomerization, etc.) in order to further enhance desirable biological activities, such as increased bioavailability and decreased proteolytic degradation.

4. Clinical Efficacy

Clinical efficacy can be measured by any method known in the art. For example, the response to a therapy, such as SFKSP therapies, relates to any response of the cancer, e.g., a tumor, to the therapy, preferably to a change in tumor mass and/or volume after initiation of neoadjuvant or adjuvant chemotherapy. Tumor response may be assessed in a neoadjuvant or adjuvant situation where the size of a tumor after systemic intervention can be compared to the initial size and dimensions as measured by CT, PET, mammogram, ultrasound or palpation and the cellularity of a tumor can be estimated histologically and compared to the cellularity of a tumor biopsy taken before initiation of treatment. Response may also be assessed by caliper measurement or pathological examination of the tumor after biopsy or surgical resection. Response may be recorded in a quantitative fashion like percentage change in tumor volume or cellularity or using a semi-quantitative scoring system such as residual cancer burden (Symmans et al., J. Clin. Oncol. (2007) 25:4414-4422) or Miller-Payne score (Ogston et al., (2003) Breast (Edinburgh, Scotland) 12:320-327) in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of tumor response may be performed early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed.

In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular SFKSP therapeutic regimen is at least 25%, 30%, 35%, 40%, 45%, 50%, 55%, 60%, 65%, 70%, 75%, 80%, 85%, or more.

Additional criteria for evaluating the response to SFKSP therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence.

For example, in order to determine appropriate threshold values, a particular SFKSP therapeutic regimen can be administered to a population of subjects and the outcome can be correlated to biomarker measurements that were determined prior to administration of any SFKSP therapy. The outcome measurement may be pathologic response to therapy given in the neoadjuvant setting. Alternatively, outcome measures, such as overall survival and disease-free survival can be monitored over a period of time for subjects following SFKSP therapy for whom biomarker measurement values are known. In certain embodiments, the same doses of SFKSP agents and/or inhibitors are administered to each subject. In related embodiments, the doses administered are standard doses known in the art for SFKSP agents and/or inhibitors. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of a SFKSP therapy can be determined using methods such as those described in the Examples section.

5. Further Uses and Methods of the Present Invention

The methods described herein can be used in a variety of diagnostic, prognostic, and therapeutic applications. In any method described herein, such as a diagnostic method, prognostic method, therapeutic method, or combination thereof, all steps of the method can be performed by a single actor or, alternatively, by more than one actor. For example, diagnosis can be performed directly by the actor providing therapeutic treatment. Alternatively, a person providing a therapeutic agent can request that a diagnostic assay be performed. The diagnostician and/or the therapeutic interventionist can interpret the diagnostic assay results to determine a therapeutic strategy. Similarly, such alternative processes can apply to other assays, such as prognostic assays. The compositions described herein can be used in a variety of diagnostic, prognostic, and therapeutic applications regarding biomarkers described herein, such as those listed in Table 1 or 2. Moreover, any method of diagnosis, prognosis, prevention, and the like described herein can be be applied to a therapy or test agent of interest, such as SFKSP therapies, endocrine therapies, and the like.

a. Screening Methods

One aspect of the present invention relates to screening assays, including non-cell based assays. In one embodiment, the assays provide a method for identifying whether a cancer is likely to respond to anti-cancer therapy (e.g., SFKSP inhibitor therapy) and/or whether an agent can inhibit the growth of or kill a cancer cell that is unlikely to respond to anti-cancer therapy (e.g., SFKSP inhibitor therapy).

In one embodiment, the invention relates to assays for screening test agents which bind to, or modulate the biological activity of, at least one biomarker listed in Table 1 or 2. In one embodiment, a method for identifying such an agent entails determining the ability of the agent to modulate, e.g. downregulate, the at least one biomarker listed in Table 2 or upregulate, the at least one biomarker listed in Table 1.

In one embodiment, an assay is a cell-free or cell-based assay, comprising contacting at least one biomarker listed in Table 2, with a test agent, and determining the ability of the test agent to modulate (e.g. inhibit or downregualte) the enzymatic activity of the biomarker, such as by measuring direct binding of substrates or by measuring indirect parameters as described below.

In one embodiment, an assay is a cell-free or cell-based assay, comprising contacting at least one biomarker listed in Table 1, with a test agent, and determining the ability of the test agent to modulate (e.g. upregulate) the enzymatic activity of the biomarker, such as by measuring direct binding of substrates or by measuring indirect parameters as described below.

In another embodiment, an assay is a cell-free or cell-based assay, comprising contacting at least one biomarker listed in Table 2, with a test agent, and determining the ability of the test agent to modulate (e.g. inhibit or downregualte) the ability of the biomarker to regulate translation of the biomarker, such as by measuring direct binding of substrates or by measuring indirect parameters as described below.

In another embodiment, an assay is a cell-free or cell-based assay, comprising contacting at least one biomarker listed in Table 1, with a test agent, and determining the ability of the test agent to modulate (e.g. upregulate) the ability of the biomarker to regulate translation of the biomarker, such as by measuring direct binding of substrates or by measuring indirect parameters as described below.

For example, in a direct binding assay, biomarker protein (or their respective target polypeptides or molecules) can be coupled with a radioisotope or enzymatic label such that binding can be determined by detecting the labeled protein or molecule in a complex. For example, the targets can be labeled with $^{125}$I, $^{35}$S, $^{14}$C, or $^{3}$H, either directly or indirectly, and the radioisotope detected by direct counting of radioemmission or by scintillation counting. Alternatively, the targets can be enzymatically labeled with, for example, horseradish peroxidase, alkaline phosphatase, or luciferase, and the enzymatic label detected by determination of conversion of an appropriate substrate to product. Determining the interaction between biomarker and substrate can also be accomplished using standard binding or enzymatic analysis assays. In one or more embodiments of the above described assay methods, it may be desirable to immobilize polypeptides or molecules to facilitate separation of complexed from uncomplexed forms of one or both of the proteins or molecules, as well as to accommodate automation of the assay.

Binding of a test agent to a target can be accomplished in any vessel suitable for containing the reactants. Non-limiting examples of such vessels include microtiter plates, test tubes, and micro-centrifuge tubes Immobilized forms of the antibodies of the present invention can also include antibodies bound to a solid phase like a porous, microporous (with an average pore diameter less than about one micron) or macroporous (with an average pore diameter of more than about 10 microns) material, such as a membrane, cellulose, nitrocellulose, or glass fibers; a bead, such as that made of agarose or polyacrylamide or latex; or a surface of a dish, plate, or well, such as one made of polystyrene.

In an alternative embodiment, determining the ability of the agent to modulate the interaction between the biomarker and its natural binding partner can be accomplished by determining the ability of the test agent to modulate the activity of a polypeptide or other product that functions downstream or upstream of its position within the SFKSP.

The present invention further pertains to novel agents identified by the above-described screening assays. Accordingly, it is within the scope of this invention to further use an agent identified as described herein in an appropriate animal model. For example, an agent identified as described herein can be used in an animal model to determine the efficacy, toxicity, or side effects of treatment with such an agent. Alternatively, an antibody identified as described herein can be used in an animal model to determine the mechanism of action of such an agent.

a. Predictive Medicine

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining the amount and/or activity level of a biomarker listed in Table 1 in the context of a biological sample (e.g., blood, serum, cells, or tissue) to thereby determine whether an individual afflicted with a cancer is likely to respond to SFKSP therapy, whether in an original or recurrent cancer. Such assays can be used for prognostic or predictive purpose to thereby prophylactically treat an individual prior to the onset or after recurrence of a disorder characterized by or associated with biomarker polypeptide, nucleic acid expression or activity.

The skilled artisan will appreciate that any method can use one or more (e.g., combinations) of biomarkers listed in Table 1.

Another aspect of the present invention pertains to monitoring the influence of agents (e.g., drugs, compounds, and small nucleic acid-based molecules) on the expression or activity of a biomarker listed in Table 1. These and other agents are described in further detail in the following sections.

The skilled artisan will also appreciated that, in certain embodiments, the methods of the present invention implement a computer program and computer system. For example, a computer program can be used to perform the algorithms described herein. A computer system can also store and manipulate data generated by the methods of the present invention which comprises a plurality of biomarker signal changes/profiles which can be used by a computer system in implementing the methods of this invention. In certain embodiments, a computer system receives biomarker expression data; (ii) stores the data; and (iii) compares the data in any number of ways described herein (e.g., analysis relative to appropriate controls) to determine the state of informative biomarkers from cancerous or pre-cancerous tissue. In other embodiments, a computer system (i) compares the determined expression biomarker level to a threshold value; and (ii) outputs an indication of whether said biomarker level is significantly modulated (e.g., above or below) the threshold value, or a phenotype based on said indication.

In certain embodiments, such computer systems are also considered part of the present invention. Numerous types of computer systems can be used to implement the analytic methods of this invention according to knowledge possessed by a skilled artisan in the bioinformatics and/or computer arts. Several software components can be loaded into memory during operation of such a computer system. The software components can comprise both software components that are standard in the art and components that are special to the present invention (e.g., dCHIP software described in Lin et al. (2004) *Bioinformatics* 20, 1233-1240; radial basis machine learning algorithms (RBM) known in the art).

The methods of the present invention can also be programmed or modeled in mathematical software packages that allow symbolic entry of equations and high-level specification of processing, including specific algorithms to be used, thereby freeing a user of the need to procedurally program individual equations and algorithms. Such packages include, e.g., Matlab from Mathworks (Natick, Mass.), Mathematica from Wolfram Research (Champaign, Ill.) or S-Plus from MathSoft (Seattle, Wash.).

In certain embodiments, the computer comprises a database for storage of biomarker data. Such stored profiles can be accessed and used to perform comparisons of interest at a later point in time. For example, biomarker expression profiles of a sample derived from the non-cancerous tissue of a subject and/or profiles generated from population-based distributions of informative loci of interest in relevant populations of the same species can be stored and later compared to that of a sample derived from the cancerous tissue of the subject or tissue suspected of being cancerous of the subject.

In addition to the exemplary program structures and computer systems described herein, other, alternative program structures and computer systems will be readily apparent to the skilled artisan. Such alternative systems, which do not depart from the above described computer system and programs structures either in spirit or in scope, are therefore intended to be comprehended within the accompanying claims.

b. Diagnostic Assays

The present invention provides, in part, methods, systems, and code for accurately classifying whether a biological sample is associated with a cancer that is likely to respond to SFKSP therapy. In some embodiments, the present invention is useful for classifying a sample (e.g., from a subject) as associated with or at risk for responding to or not responding to SFKSP therapy using a statistical algorithm and/or empirical data (e.g., the amount or activity of a biomarker listed in Table 1).

An exemplary method for detecting the amount or activity of a biomarker listed in Table 1, and thus useful for classifying whether a sample is likely or unlikely to respond to SFKSP therapy involves obtaining a biological sample from a test subject and contacting the biological sample with an agent, such as a protein-binding agent like an antibody or antigen-binding fragment thereof, or a nucleic acid-binding agent like an oligonucleotide, capable of detecting the amount or activity of the biomarker in the biological sample. In some embodiments, at least one antibody or antigen-binding fragment thereof is used, wherein two, three, four, five, six, seven, eight, nine, ten, or more such antibodies or antibody fragments can be used in combination (e.g., in sandwich ELISAs) or in serial. In certain instances, the statistical algorithm is a single learning statistical classifier system. For example, a single learning statistical classifier system can be used to classify a sample as a based upon a prediction or probability value and the presence or level of the biomarker. The use of a single learning statistical classifier system typically classifies the sample as, for example, a likely SFKSP therapy responder or progressor sample with a sensitivity, specificity, positive predictive value, negative predictive value, and/or overall accuracy of at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Other suitable statistical algorithms are well known to those of skill in the art. For example, learning statistical classifier systems include a machine learning algorithmic technique capable of adapting to complex data sets (e.g., panel of markers of interest) and making decisions based upon such data sets. In some embodiments, a single learning statistical classifier system such as a classification tree (e.g., random forest) is used. In other embodiments, a combination of 2, 3, 4, 5, 6, 7, 8, 9, 10, or more learning statistical classifier systems are used, preferably in tandem. Examples of learning statistical classifier systems include, but are not limited to, those using inductive learning (e.g., decision/classification trees such as random forests, classification and regression trees (C&RT), boosted trees, etc.), Probably Approximately Correct (PAC) learning, connectionist learning (e.g., neural networks (NN), artificial neural networks (ANN), neuro fuzzy networks (NFN), network structures, perceptrons such as multi-layer perceptrons, multi-layer feed-forward networks, applications of neural networks, Bayesian learning in belief networks, etc.), reinforcement learning (e.g., passive learning in a known environment such as naive learning, adaptive dynamic learning, and temporal difference learning, passive learning in an unknown environment, active learning in an unknown environment, learning action-value functions, applications of reinforcement learning, etc.), and genetic algorithms and evolutionary programming Other learning statistical classifier systems include support vector machines (e.g., Kernel methods), multivariate adaptive regression splines (MARS), Levenberg-Marquardt algorithms, Gauss-Newton algorithms, mixtures of Gaussians, gradient descent algorithms, and learning vector quantization (LVQ). In certain embodiments, the method of the present invention further comprises sending the sample classification results to a clinician, e.g., an oncologist.

In another embodiment, the diagnosis of a subject is followed by administering to the individual a therapeutically effective amount of a defined treatment based upon the diagnosis.

In one embodiment, the methods further involve obtaining a control biological sample (e.g., biological sample from a subject who does not have a cancer or whose cancer is susceptible to SFKSP therapy), a biological sample from the subject during remission, or a biological sample from the subject during treatment for developing a cancer progressing despite SFKSP therapy.

c. Prognostic Assays

The diagnostic methods described herein can furthermore be utilized to identify subjects having or at risk of developing a cancer that is likely or unlikely to be responsive to SFKSP therapy. The assays described herein, such as the preceding diagnostic assays or the following assays, can be utilized to identify a subject having or at risk of developing a disorder associated with a misregulation of the amount or activity of at least one biomarker described in Table 1, such as in cancer. Alternatively, the prognostic assays can be utilized to identify a subject having or at risk for developing a disorder associated with a misregulation of the at least one biomarker described in Table 1, such as in cancer. Furthermore, the prognostic assays described herein can be used to determine whether a subject can be administered an agent (e.g., an agonist, antagonist, peptidomimetic, polypeptide, peptide, nucleic acid, small molecule, or other drug candidate) to treat a disease or disorder associated with the aberrant biomarker expression or activity.

e. Treatment Methods

The compositions described herein (including dual binding antibodies and derivatives and conjugates thereof) can be used in a variety of in vitro and in vivo therapeutic applications using the formulations and/or combinations described herein. In one embodiment, SFKSP therapy can be used to treat cancers determined to be responsive thereto. For example, agents that inhibit PAK2 and/or SFK (e.g., Dasatinib, Saracatinib, PRAX597, and the like) can be used to treat cancer in subjects identified as likely responders thereto.

Another aspect of the invention pertains to methods of modulating the expression or activity of one or more biomarkers described herein (e.g., those listed in Tables 1 or 2 and the Examples or fragments thereof) for therapeutic purposes. The biomarkers of the present invention have been demonstrated to correlate with c-MYC-dependent cancers. Accordingly, the activity and/or expression of the biomarker, as well as the interaction between one or more biomarkers or a fragment thereof and its natural binding partner(s) or a fragment(s) thereof, can be modulated in order to treat c-MYC-dependent cancers.

Another aspect of the invention pertains to methods of modulating the expression or activity of one or more biomarkers described herein (e.g., those listed in Table 1 and the Examples or fragments thereof) for therapeutic purposes. The biomarkers of the present invention have been demonstrated to correlate with cancers. Accordingly, the activity and/or expression of the biomarker, as well as the interaction between one or more biomarkers or a fragment thereof and its natural binding partner(s) or a fragment(s) thereof, can be modulated in order to treat cancers.

Modulatory methods of the invention involve contacting a cell with one or more biomarkers of the invention, including one or more biomarkers of the invention, including one or more biomarkers listed in Table 1 or 2 and the Examples or a fragment thereof or agent that modulates one or more of the activities of biomarker activity associated with the cell. An agent that modulates biomarker activity can be an agent as described herein, such as a nucleic acid or a polypeptide, a naturally-occurring binding partner of the biomarker, an antibody against the biomarker, a combination of antibodies against the biomarker and antibodies against other immune related targets, one or more biomarkers agonist or antagonist, a peptidomimetic of one or more biomarkers agonist or antagonist, one or more biomarkers peptidomimetic, other small molecule, or small RNA directed against or a mimic of one or more biomarkers nucleic acid gene expression product.

An agent that modulates the expression of one or more biomarkers of the present invention, including one or more biomarkers of the invention, including one or more biomarkers listed in Table 1 or 2 and the Examples or a fragment thereof is, e.g., an antisense nucleic acid molecule, RNAi molecule, shRNA, mature miRNA, pre-miRNA, pri-miRNA, miRNA*, anti-miRNA, or a miRNA binding site, or a variant thereof, or other small RNA molecule, triplex oligonucleotide, ribozyme, or recombinant vector for expression of one or more biomarkers polypeptide. For example, an oligonucleotide complementary to the area around one or more biomarkers polypeptide translation initiation site can be synthesized. One or more antisense oligonucleotides can be added to cell media, typically at 200 µg/ml, or administered to a patient to prevent the synthesis of one or more biomarkers polypeptide. The antisense oligonucleotide is taken up by cells and hybridizes to one or more biomarkers mRNA to prevent translation. Alternatively, an oligonucleotide which binds double-stranded DNA to form a triplex construct to prevent DNA unwinding and transcription can be used. As a result of either, synthesis of biomarker polypeptide is blocked. When biomarker expression is modulated, preferably, such modulation occurs by a means other than by knocking out the biomarker gene.

Agents which modulate expression, by virtue of the fact that they control the amount of biomarker in a cell, also modulate the total amount of biomarker activity in a cell.

In one embodiment, the agent stimulates one or more activities of one or more biomarkers of the invention, including one or more biomarkers listed in Table 1 or 2 and the Examples or a fragment thereof. Examples of such stimulatory agents include active biomarker polypeptide or a fragment thereof and a nucleic acid molecule encoding the biomarker or a fragment thereof that has been introduced into the cell (e.g., cDNA, mRNA, shRNAs, siRNAs, small RNAs, mature miRNA, pre-miRNA, pri-miRNA, miRNA*, anti-miRNA, or a miRNA binding site, or a variant thereof, or other functionally equivalent molecule known to a skilled artisan). In another embodiment, the agent inhibits one or more biomarker activities. In one embodiment, the agent inhibits or enhances the interaction of the biomarker with its natural binding partner(s). Examples of such inhibitory agents include antisense nucleic acid molecules, anti-biomarker antibodies, biomarker inhibitors, and compounds identified in the screening assays described herein.

These modulatory methods can be performed in vitro (e.g., by contacting the cell with the agent) or, alternatively, by contacting an agent with cells in vivo (e.g., by administering the agent to a subject). As such, the present invention provides methods of treating an individual afflicted with a condition or disorder that would benefit from up- or down-modulation of one or more biomarkers of the present invention listed in Table 1 or 2 and the Examples or a fragment thereof, e.g., a disorder characterized by unwanted, insufficient, or aberrant expression or activity of the biomarker or fragments thereof. In one embodiment, the method involves administering an agent (e.g., an agent identified by a screening assay described herein), or combination of agents that modulates (e.g., upregulates or downregulates) biomarker expression or activity. In another embodiment, the method involves administering one or more biomarkers polypeptide or nucleic acid molecule as therapy to compensate for reduced, aberrant, or unwanted biomarker expression or activity.

Stimulation of biomarker activity is desirable in situations in which the biomarker is abnormally downregulated and/or in which increased biomarker activity is likely to have a beneficial effect. Likewise, inhibition of biomarker activity is desirable in situations in which biomarker is abnormally upregulated and/or in which decreased biomarker activity is likely to have a beneficial effect.

In addition, these modulatory agents can also be administered in combination therapy with, e.g., chemotherapeutic agents, hormones, antiangiogens, radiolabelled, compounds, or with surgery, cryotherapy, and/or radiotherapy. The preceding treatment methods can be administered in conjunction with other forms of conventional therapy (e.g., standard-of-care treatments for cancer well known to the skilled artisan), either consecutively with, pre- or post-conventional therapy. For example, these modulatory agents can be administered with a therapeutically effective dose of chemotherapeutic agent. In another embodiment, these modulatory agents are administered in conjunction with chemotherapy to enhance the activity and efficacy of the chemotherapeutic agent. The Physicians' Desk Reference (PDR) discloses dosages of chemotherapeutic agents that have been used in the treatment of various cancers. The dosing regimen and dosages of these aforementioned chemotherapeutic drugs that are therapeutically effective will depend on the particular melanoma, being treated, the extent of the disease and other factors familiar to the physician of skill in the art and can be determined by the physician.

6. Pharmaceutical Compositions

In another aspect, the present invention provides pharmaceutically acceptable compositions which comprise a therapeutically-effective amount of an agent that modulates (e.g., decreases) biomarker expression and/or activity, formulated together with one or more pharmaceutically acceptable carriers (additives) and/or diluents. As described in detail below, the pharmaceutical compositions of the present invention may be specially formulated for administration in solid or liquid form, including those adapted for the following: (1) oral administration, for example, drenches (aqueous or non-aqueous solutions or suspensions), tablets, boluses, powders, granules, pastes; (2) parenteral administration, for example, by subcutaneous, intramuscular or intravenous injection as, for example, a sterile solution or suspension; (3) topical application, for example, as a cream, ointment or spray applied to the skin; (4) intravaginally or intrarectally, for example, as a pessary, cream or foam; or (5) aerosol, for example, as an aqueous aerosol, liposomal preparation or solid particles containing the compound.

The phrase "therapeutically-effective amount" as used herein means that amount of an agent that modulates (e.g., inhibits) biomarker expression and/or activity, or expression and/or activity of the complex, or composition comprising an agent that modulates (e.g., inhibits) biomarker expression and/or activity, or expression and/or activity of the complex, which is effective for producing some desired therapeutic effect, e.g., cancer treatment, at a reasonable benefit/risk ratio.

The phrase "pharmaceutically acceptable" is employed herein to refer to those agents, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, solvent or encapsulating material, involved in carrying or transporting the subject chemical from one organ, or portion of the body, to another organ, or portion of the body. Each carrier must be "acceptable" in the sense of being compatible with the other ingredients of the formulation and not injurious to the subject. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) phosphate buffer solutions; and (21) other non-toxic compatible substances employed in pharmaceutical formulations.

The term "pharmaceutically-acceptable salts" refers to the relatively non-toxic, inorganic and organic acid addition salts of the agents that modulates (e.g., inhibits) biomarker expression and/or activity, or expression and/or activity of the complex encompassed by the present invention. These salts can be prepared in situ during the final isolation and purification of the therapeutic agents, or by separately reacting a purified therapeutic agent in its free base form with a suitable organic or inorganic acid, and isolating the salt thus formed. Representative salts include the hydrobromide, hydrochloride, sulfate, bisulfate, phosphate, nitrate, acetate, valerate, oleate, palmitate, stearate, laurate, benzoate, lactate, phosphate, tosylate, citrate, maleate, fumarate, succinate, tartrate, napthylate, mesylate, glucoheptonate, lactobionate, and laurylsulphonate salts and the like (See, for example, Berge et al. (1977) "Pharmaceutical Salts", *J. Pharm. Sci.* 66:1-19).

In other cases, the agents useful in the methods of the present invention may contain one or more acidic functional groups and, thus, are capable of forming pharmaceutically-acceptable salts with pharmaceutically-acceptable bases. The term "pharmaceutically-acceptable salts" in these instances refers to the relatively non-toxic, inorganic and organic base addition salts of agents that modulates (e.g., inhibits) biomarker expression and/or activity, or expression and/or activity of the complex. These salts can likewise be prepared in situ during the final isolation and purification of the therapeutic agents, or by separately reacting the purified therapeutic agent in its free acid form with a suitable base, such as the hydroxide, carbonate or bicarbonate of a pharmaceutically-acceptable metal cation, with ammonia, or with a pharmaceutically-acceptable organic primary, secondary or tertiary amine Representative alkali or alkaline earth salts include the lithium, sodium, potassium, calcium, magnesium, and aluminum salts and the like. Representative organic amines useful for the formation of base addition salts include ethylamine, diethylamine, ethylenediamine, ethanolamine, diethanolamine, piperazine and the like (see, for example, Berge et al., supra).

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically-acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Formulations useful in the methods of the present invention include those suitable for oral, nasal, topical (including buccal and sublingual), rectal, vaginal, aerosol and/or parenteral administration. The formulations may conveniently be presented in unit dosage form and may be prepared by any methods well known in the art of pharmacy. The amount of active ingredient which can be combined with a carrier material to produce a single dosage form will vary depending upon the host being treated, the particular mode of administration. The amount of active ingredient, which can be combined with a carrier material to produce a single dosage form will generally be that amount of the compound which produces a therapeutic effect. Generally, out of one hundred percent, this amount will range from about 1 percent to about ninety-nine percent of active ingredient, preferably from about 5 percent to about 70 percent, most preferably from about 10 percent to about 30 percent.

Methods of preparing these formulations or compositions include the step of bringing into association an agent that modulates (e.g., inhibits) biomarker expression and/or activity, with the carrier and, optionally, one or more accessory ingredients. In general, the formulations are prepared by uniformly and intimately bringing into association a therapeutic agent with liquid carriers, or finely divided solid carriers, or both, and then, if necessary, shaping the product.

Formulations suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a therapeutic agent as an active ingredient. A compound may also be administered as a bolus, electuary or paste.

In solid dosage forms for oral administration (capsules, tablets, pills, dragees, powders, granules and the like), the active ingredient is mixed with one or more pharmaceutically-acceptable carriers, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets and pills, the pharmaceutical compositions may also comprise buffering agents. Solid compositions of a similar type may also be employed as fillers in soft and hard-filled gelatin capsules using such excipients as lactose or milk sugars, as well as high molecular weight polyethylene glycols and the like.

A tablet may be made by compression or molding, optionally with one or more accessory ingredients. Compressed tablets may be prepared using binder (for example, gelatin or hydroxypropylmethyl cellulose), lubricant, inert diluent, preservative, disintegrant (for example, sodium starch glycolate or cross-linked sodium carboxymethyl cellulose), surface-active or dispersing agent. Molded tablets may be made by molding in a suitable machine a mixture of the powdered peptide or peptidomimetic moistened with an inert liquid diluent.

Tablets, and other solid dosage forms, such as dragees, capsules, pills and granules, may optionally be scored or prepared with coatings and shells, such as enteric coatings and other coatings well known in the pharmaceutical-formulating art. They may also be formulated so as to provide slow or controlled release of the active ingredient therein using, for example, hydroxypropylmethyl cellulose in varying proportions to provide the desired release profile, other polymer matrices, liposomes and/or microspheres. They may be sterilized by, for example, filtration through a bacteria-retaining filter, or by incorporating sterilizing agents in the form of sterile solid compositions, which can be dissolved in sterile water, or some other sterile injectable medium immediately before use. These compositions may also optionally contain opacifying agents and may be of a composition that they release the active ingredient(s) only, or preferentially, in a certain portion of the gastrointestinal tract, optionally, in a delayed manner. Examples of embedding compositions, which can be used include polymeric substances and waxes. The active ingredient can also be in micro-encapsulated form, if appropriate, with one or more of the above-described excipients.

Liquid dosage forms for oral administration include pharmaceutically acceptable emulsions, microemulsions, solutions, suspensions, syrups and elixirs. In addition to the active ingredient, the liquid dosage forms may contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof.

Besides inert diluents, the oral compositions can also include adjuvants such as wetting agents, emulsifying and suspending agents, sweetening, flavoring, coloring, perfuming and preservative agents.

Suspensions, in addition to the active agent may contain suspending agents as, for example, ethoxylated isostearyl alcohols, polyoxyethylene sorbitol and sorbitan esters, microcrystalline cellulose, aluminum metahydroxide, bentonite, agar-agar and tragacanth, and mixtures thereof.

Formulations for rectal or vaginal administration may be presented as a suppository, which may be prepared by mixing one or more therapeutic agents with one or more suitable nonirritating excipients or carriers comprising, for example, cocoa butter, polyethylene glycol, a suppository wax or a salicylate, and which is solid at room temperature, but liquid at body temperature and, therefore, will melt in the rectum or vaginal cavity and release the active agent.

Formulations which are suitable for vaginal administration also include pessaries, tampons, creams, gels, pastes, foams or spray formulations containing such carriers as are known in the art to be appropriate.

Dosage forms for the topical or transdermal administration of an agent that modulates (e.g., inhibits) biomarker expression and/or activity include powders, sprays, ointments, pastes, creams, lotions, gels, solutions, patches and inhalants. The active component may be mixed under sterile conditions with a pharmaceutically-acceptable carrier, and with any preservatives, buffers, or propellants which may be required.

The ointments, pastes, creams and gels may contain, in addition to a therapeutic agent, excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain, in addition to an agent that modulates (e.g., inhibits) biomarker expression and/or activity, excipients such as lactose, talc, silicic acid, aluminum hydroxide, calcium silicates and polyamide powder, or mixtures of these substances. Sprays can additionally contain customary propellants, such as chlorofluorohydrocarbons and volatile unsubstituted hydrocarbons, such as butane and propane.

The agent that modulates (e.g., inhibits) biomarker expression and/or activity, can be alternatively administered by aerosol. This is accomplished by preparing an aqueous aerosol, liposomal preparation or solid particles containing the compound. A nonaqueous (e.g., fluorocarbon propellant) suspension could be used. Sonic nebulizers are preferred because they minimize exposing the agent to shear, which can result in degradation of the compound.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Transdermal patches have the added advantage of providing controlled delivery of a therapeutic agent to the body. Such dosage forms can be made by dissolving or dispersing the agent in the proper medium. Absorption enhancers can also be used to increase the flux of the peptidomimetic across the skin. The rate of such flux can be controlled by either providing a rate controlling membrane or dispersing the peptidomimetic in a polymer matrix or gel.

Ophthalmic formulations, eye ointments, powders, solutions and the like, are also contemplated as being within the scope of this invention.

Pharmaceutical compositions of this invention suitable for parenteral administration comprise one or more therapeutic agents in combination with one or more pharmaceutically-acceptable sterile isotonic aqueous or nonaqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents.

Examples of suitable aqueous and nonaqueous carriers which may be employed in the pharmaceutical compositions of the present invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of the action of microorganisms may be ensured by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution, which, in turn, may depend upon crystal size and crystalline form. Alternatively, delayed absorption of a parenterally-administered drug form is accomplished by dissolving or suspending the drug in an oil vehicle.

Injectable depot forms are made by forming microencapsule matrices of an agent that modulates (e.g., inhibits) biomarker expression and/or activity, in biodegradable polymers such as polylactide-polyglycolide. Depending on the ratio of drug to polymer, and the nature of the particular polymer employed, the rate of drug release can be controlled. Examples of other biodegradable polymers include poly(orthoesters) and poly(anhydrides). Depot injectable formulations are also prepared by entrapping the drug in liposomes or microemulsions, which are compatible with body tissue.

When the therapeutic agents of the present invention are administered as pharmaceuticals, to humans and animals, they can be given per se or as a pharmaceutical composition containing, for example, 0.1 to 99.5% (more preferably, 0.5 to 90%) of active ingredient in combination with a pharmaceutically acceptable carrier.

Actual dosage levels of the active ingredients in the pharmaceutical compositions of this invention may be determined by the methods of the present invention so as to obtain an amount of the active ingredient, which is effective to achieve the desired therapeutic response for a particular subject, composition, and mode of administration, without being toxic to the subject.

The nucleic acid molecules of the present invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054 3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The present invention also encompasses kits for detecting and/or modulating biomarkers described herein. A kit of the present invention may also include instructional materials disclosing or describing the use of the kit or an antibody of the disclosed invention in a method of the disclosed invention as provided herein. A kit may also include additional components to facilitate the particular application for which the kit is designed. For example, a kit may additionally contain means of detecting the label (e.g., enzyme substrates for enzymatic labels, filter sets to detect fluorescent labels, appropriate secondary labels such as a sheep anti-mouse-HRP, etc.) and reagents necessary for controls (e.g., control biological samples or standards). A kit may additionally include buffers and other reagents recognized for use in a method of the disclosed invention. Non-limiting examples include agents to reduce non-specific binding, such as a carrier protein or a detergent.

Other embodiments of the present invention are described in the following Examples. The present invention is further illustrated by the following examples which should not be construed as further limiting.

EXEMPLIFICATION

Example 1: Materials and Methods for Examples 2-6 a. Breast Cancer Cell Culture

The MCF-7, and T47D, human cell lines were grown as described previously (Neve et al. (2006) Cancer Cell 10:515-527). Tam-R and Flu-R cells were derived by long-term exposure to tamoxifen and Fluvestrant grown under the same conditions as wild-type MCF-7 and T47D cells (Knowlden et al. (2003) Endocrinology 144:1032-1044). T47D/LTED and MCF-7/LTED cells were generated through culture in phenol red-free RPMI1640 and DMEM supplemented with 10% dextran-charcoaltreated FBS [DCC-FBS (Hyclone)] (Miller et al. (2010) J. Clin. Invest. 120:2406-2413).

b. Plasmids and Inhibitors

The lentiviral gCSK, gAAVS1, gPAK-2 and gCSK_enhancer vectors were generated by ligation of hybridized oligos (Table 10) into LentiCRISPR-v2 vector (Addgene) linearized with BsmBI using quick ligase (NEB).

TABLE 10

| | |
|---|---|
| CACCGTACAAAGCCAAAAACAAGG | gCSK_1_F |
| AAACCCTTGTTTTTGGCTTTGTAC | gCSK_1_R |
| CACCGGAGCGGCTTCTGTACCCGC | gCSK_2_F |
| AAACGCGGGTACAGAAGCCGCTCC | gCSK_2_R |
| CACCGGCAACTGCGGCATAGCAACC | gCSK_3_F |
| AAACGGTTGCTATGCCGCAGTTGCC | gCSK_3_R |
| CACCGGTGACCTGCCCGGTTCTCAG | gAAVS1_1_F |
| AAACCTGAGAACCGGGCAGGTCACC | gAAVS1_1_R |
| CACCGCGGGGACACAGGATCCCTGG | gAAVS1_2_F |
| AAACCCAGGGATCCTGTGTCCCCGC | gAAVS1_2_R |
| CACCGGTTAGGGCATGCCAGAACAG | gPAK2_1_F |
| AAACCTGTTCTGGCATGCCCTAACC | gPAK2_1_R |
| CACCGATGGTGTGCTCAAAATCAGA | gPAK2_2_F |
| AAACTCTGATTTTGAGCACACCATC | gPAK2_2_R |
| CACCGGGACATCCAGCACAGCCTG | gPAK2_3_F |
| AAACCAGGCTGTGCTGGATGTCCC | gPAK2_3_R |
| CACCGTGGTGGTGGCCTTCAAATCA | CSK_eh_gRNA1_F |
| AAACTGATTTGAAGGCCACCACCAC | CSK_eh_gRNA1_R |
| CACCGCAGGGAGCAGCCCACGGTAG | CSK_eh_gRNA2_F |
| AAACCTACCGTGGGCTGCTCCCTGC | CSK_eh_gRNA2_R |
| CACCGAGCGCCACCAGAGACCAGAC | CSK_eh_gRNA3_F |
| AAACGTCTGGTCTCTGGTGGCGCTC | CSK_eh_gRNA3_R |
| CACCGCTAGAATCCAGTCTGGTCTC | CSK_eh_gRNA4_F |
| AAACGAGACCAGACTGGATTCTAGC | CSK_eh_gRNA4_R |
| CACCGAGTAATCACCCAGAGTGCAA | CSK_eh_gRNA5_F |
| AAACTTGCACTCTGGGTGATTACTC | CSK_eh_gRNA5_R |
| CACCGAGAGGACTTGGAGTCGCTGA | CSK_eh_gRNA6_F |
| AAACTCAGCGACTCCAAGTCCTCTC | CSK_eh_gRNA6_R |
| CCTTGAAGGAAGATGATCAAATGAGAGC | CSK-Eh-PCR_F |
| CCAGCCTGGGGCCAGTTCTTATC | CSK-Eh_PCR_R |

For enhancer deletion by pairs of gRNA, the LentiCRIPSR V2 vector was modified by substituting blasticidin resistant gene for puromycin resistant gene. Then CSK_eh_gRNA1, CSK_eh_gRNA2, CSK_eh_gRNA3, and CSK_eh_gRNA5 was cloned into LentiCRISPR_puro vector, and CSK_eh_gRNA3, CSK_eh_gRNA4, CSK_eh_gRNA3, and CSK_eh_gRNA6 into LentiCRISPR_blast vector. After a pair of gRNA (gRNA1+gRNA3) was delivered into cells by lentivirus, the cell was selected by both puromycin and blasticidin.

The pLX-gRNA vector (Addgene) was used to generate lentiviral gCSK_1, gCSK_3, gAAVS1_1, gAAVS_2 vectors for the secondary CRISPR screens by the protocol from Addgene.

The vectors of inducible overexpression of CSK and PAK2 were generated by cloning the ORFs of CSK and PAK2 genes into the pCW-Cas9 vectors. The CSK or PAK2 genes were substituted for Cas9 by double restriction enzyme digestion (NheI and BamHI). The primers were used in Table 11 as follows:

TABLE 11

| | |
|---|---|
| AGTCAGCTAGCATGTCAGCAATACAGGCCGCCTG | CSK_nheI_F |
| AGTCAGGATCCTCAAGCGTAATCTGGAACATCGTATGGGTACAGGTGCAGCTCGTGGGTTTTG | CSK_BamHI_R |
| AGTCAGCTAGCATGTCTGATAACGGAGAACTGGAAGATAAGCC | PAK2_nheI_F |
| AGTCAGGATCCTTACTTGTCGTCATCGTCTTTGTAGTCACGGTTACTCTTCATTGCTTCTTTAGCTGCC | PAK2_BamHI_R |

The gCSK resistant CSK cDNAs were generated by introducing a mutation (NGG→NTG) at PAM without changing the amino acid. And the Q5® Site-Directed Mutagenesis Kit (NEB) was used with the primers (Table 12):

TABLE 12

| | |
|---|---|
| GTTGGCCGTGAGGGCATCATC | CSK1_mut_R_F |
| CTTGTTTTTGGCTTTGTACCAGTTGG | CSK1_mut_R_R |
| CGCCTGAGACAGGCCTGTTCCTG | CSK2_mut_R_F |
| GGTACAGAAGCCGCTCAGCCTGCTC | CSK2_mut_R_R |
| CTTGTGCAGCTCCTGGGCGTGA | CSK3_mut_R_F |
| GTTGCTATGCCGCAGTTGCGTCA | CSK3_mut_R_R |

The gPAK2_3 targets the intron-exon boundary of PAK2 in human genome, thus it will not affect the PAK2 cDNA.

Amino-acid substitution mutants of PAK2 (Y130F, Y139F, Y194F) were generated by the Q5® Site-Directed Mutagenesis Kit (NEB) with the following primers (Table 13):

TABLE 13

| | |
|---|---|
| AAGTTCTTCGACTCCAACACAGTGAAGCAGA | PAK2_mut_Y130_F |
| TAGGACATCCAGCACAGCCTGAGG | PAK2_mut_Y130_R |
| CAGAAATTTCTGAGCTTTACTCCTCCTGAGAAAGATG | PAK2_mut_Y139_F |
| CTTCACTGTGTTGGAGTCGTAGAACTTTAGGAC | PAK2_mut_Y139_R |
| TCAATTTTCACACGGTCTGTAATTGACCCTG | PAK2_mut_Y194_F |
| TTTCGTATGATCCGGTCGCGG | PAK2_mut_Y194_R |

Inhibitors used in this work include: Dasatinib, Saracatinib, and PRAX597 were purchased from Selleck Chemicals. Tamoxifen and Fulvestrant were purchased.

c. CRISPR Screens

GeCKO v2 library (Sanjana et al. (2014) *Nat. Methods* 11:783-784) from Addgene was used for the genome-wide CRISPR screens. Cells of interest are infected at a low MOI (0.3-0.5) to ensure that most cells receive only 1 viral construct with high probability. To find optimal virus volumes for achieving an MOI of 0.3-0.5, each new cell type and new virus lots will be tested by spinfecting $3\times10^6$ cells with several different volumes of virus. Briefly, $3\times10^6$ cells per well are plated into a 12 well plate in the appropriate standard media for the cell type (see below) supplemented with 8 ug/ml polybrene. For T47D cells, standard media is RPMI 1640 supplemented with 10% FBS. Each well receives a different titrated virus amount (usually between 5 and 50 μl) along with a no-transduction control. The 12-well plate is centrifuged at 2,000 rpm for 2 h at 37° C. After the spin, media is aspirated and fresh media (without polybrene) is added. Cells are incubated overnight and then enzymatically detached using trypsin. Cells are counted and each well is split into duplicate wells. One replicate receives 2 μg/mL puromycin for MCF7 cells or 4 μg/ml puromycin for T47D cells. After 3 days (or as soon as no surviving cells remained in the no-transduction control under puromycin selection), cells are counted to calculate a percent transduction. Percent transduction is calculated as cell count from the replicate with puromycin divided by cell count from the replicate without puromycin multiplied by 100. The virus volume yielding a MOI closest to 0.4 will be chosen for large-scale screening.

For each cell lines, large-scale spin-infection of $2\times10^8$ cells will be carried out using four of 12-well plates with $4\times10^6$ cells per well. Wells are pooled together into larger flasks on the day after spinfection. For most cell types, 0.5-4 μg/ml puromycin works well, although the minimum dose that kills all cells without any viral transduction will be determined in advance and the minimum concentration will be used for selection. After three days of puromycin selection, the surviving cells (T47D and MCF7) will be divided into three groups (0 day control, vehicle, and with hormone) and cultured for four weeks before genomic DNA extraction and analysis. Two round of PCR will be performed after gDNA has been extracted, and 300 μg DNA per sample will be used for library construction. Each library will be sequenced at 30-40 million reads to achieve ~300× average coverage over the CRISPR library. The 0 day sample library of each screen could serve as controls to identify positively or negatively selected genes or pathways.

For the second round of Genome-wide CRISPR screens, T47D cells were first transfected with lentiviral gCSK_1, gCSK_3, gAAVS1_1, gAAVS_2 cloned by pLX-gRNA vector. After blasticidin selection, the following four types of T47D cells were generated with stable expression of gCSK_1, gCSK_3, gAAVS1_1, gAAVS_2 respectively. Then the Genome-wide CRISPR screens were performed in these four cell types by the above method.

PCR Primers for Library Construction:
The first round of PCR (Table 14):

TABLE 14

| | |
|---|---|
| AATGGACTATCATATGCTTACCGTAACTTGAAAGTATTTCG | lentiCRISPR_F1 |
| TCTACTATTCTTTCCCCTGCACTGTACCTGTGGGCGATGTGCGCTCTG | lentiCRISPR_R1 |

The second round of PCR (Table 15):

TABLE 15

| | |
|---|---|
| AATGATACGGCGACCACCGAGATCTACACTCTTTCC CTACACGACGCTCTTCCGATCTTCTTGTGGAAAGGA CGAAACACCG | Cri_library_F |
| CAAGCAGAAGACGGCATACGAGATGTGACTGGAGTT CAGACGTGTGCTCTTCCGATCTXXXXXXTCTACTAT TCTTTCCCCTGCACTGTACC | Cri_library_R |

Figure 18:
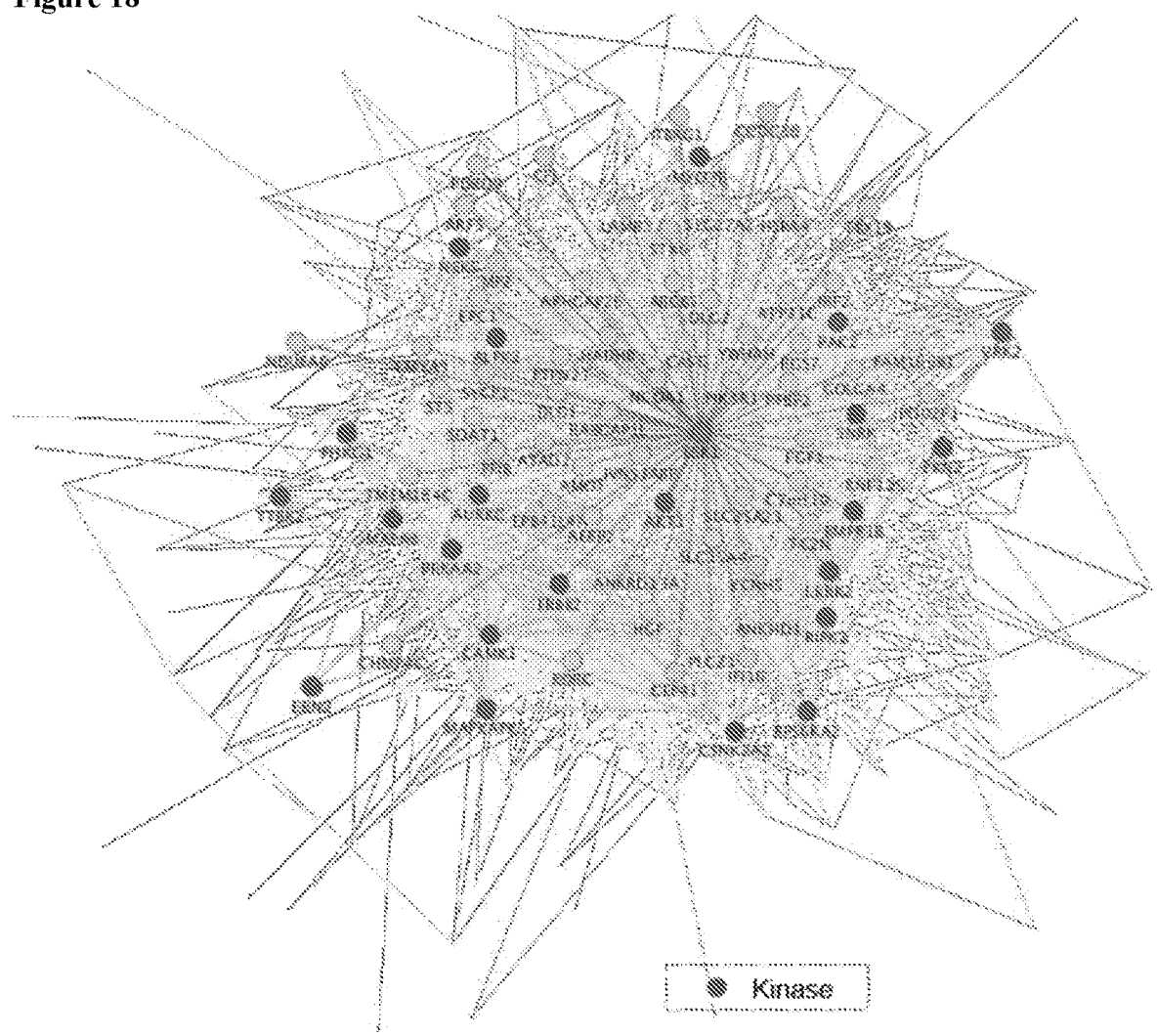
FIG. 18 shows a network view of 649 specific essential genes in T47D CSK null cells. Dots represent essential genes, and edges indicate two genes have genetic, physical interactions, are co-localized, or are in the same pathway. The network is extracted from GeneMANIA56. Kinases are marked as blue, and genes connected with ER are highlighted.
Figure 19:
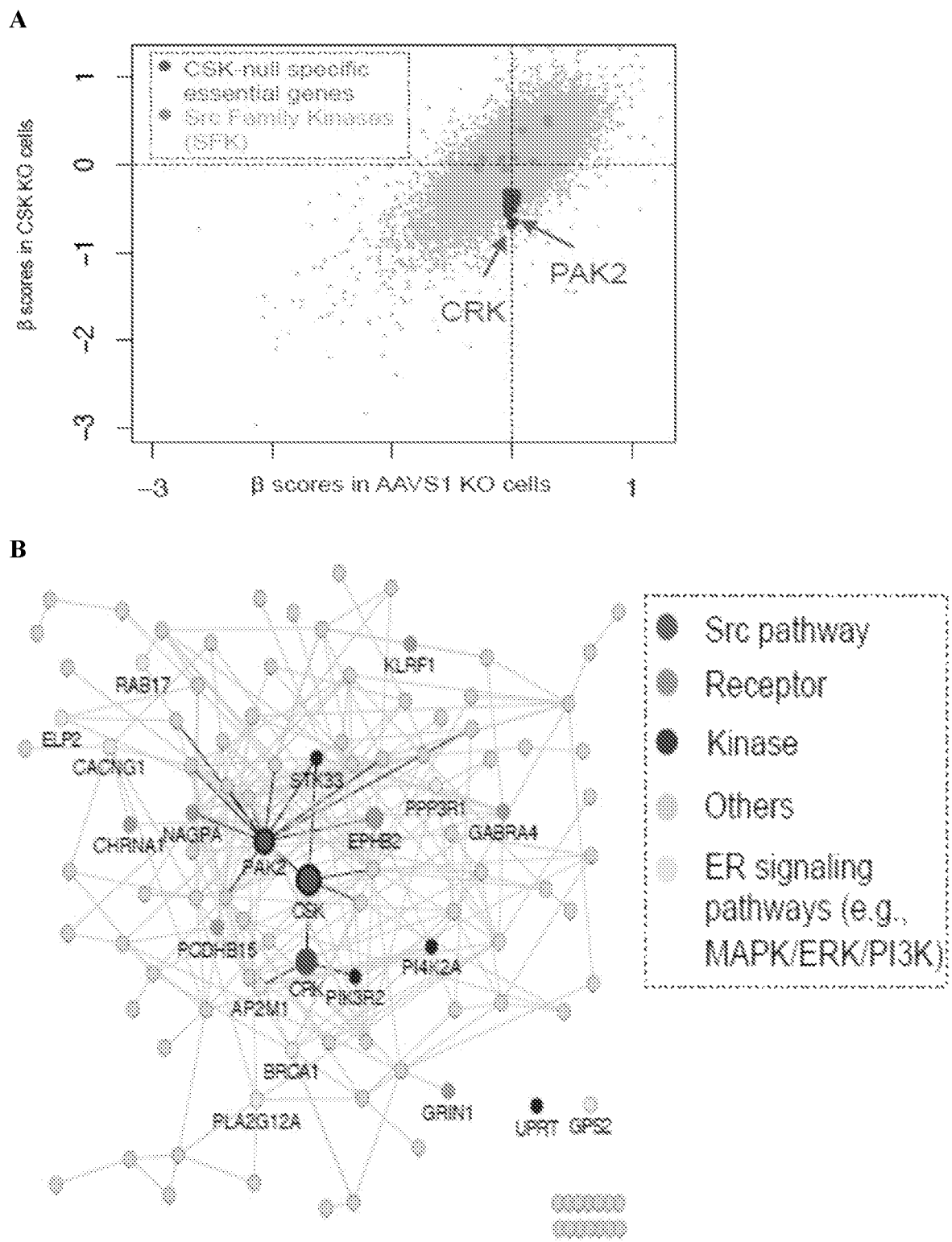
FIG. 19 includes 2 panels, identified as panels A and B. The beta scores of specific essential genes CSK null cells compared with CSK wild-type cells (Panel A). Two Src pathway genes (PAK2 and CRK), and Src Family Kinases (SFKs) are marked. An interaction network of genes that become essential upon CSK loss (Panel B). Edges connecting genes indicate possible gene interactions from public datasets.

(XXXXXX denotes the sample barcode)
Sequencing primer (read1):
CTCTTCCGATCTTCTTGTGGAAAGGACGAAACACCG
Indexing primer:
CATCGCCCACAGGTACAGTGCAGGGGAAAGAATAGTAGA d. Computational Analysis of the Screens The CRISPR/Cas9 screening data were processed and analyzed using the MAGeCK and MAGeCK-VISPR algorithms as previously developed (Li, W et al. (2014) *Genome Biol.* 15:554; Li, W et al. (2015) *Genome Biol.* 16:281). The MAGeCK-VISPR algorithm (Li, W et al. (2015) *Genome Biol.* 16:281) was used to compare the gene selections across different conditions and different studies (FIG. 1, Panel D, FIGS. 7, 10-11, and 18), as well as CSK-null specific essential genes (FIG. 19). MAGeCK-VISPR uses a metric, "β score", to measure gene selections. The definition of β score is similar to the term of 'log fold change' in differential expression analysis, and β>0 (or <0) means the corresponding gene is positively (or negatively) selected, respectively. MAGeCK-VISPR models the gRNA read counts as an NB variable, whose mean value is determined by the sequencing depth of the sample, the efficiency of the gRNA, and a linear combination of β scores of the genes. MAGeCK-VISPR then builds a maximum likelihood (MLE) model to model all gRNA read counts of all samples, and iteratively estimate the gRNA efficiency and gene β scores using the Expectation-Maximization (EM) algorithm. A detailed description of the MAGeCK-MLE algorithm can be found in the original study (Li, W et al. (2015) *Genome Biol.* 16:281).

To identify breast cancer specific essential genes (FIG. 1, Panels C and D, FIG. 18), three public genome-wide CRISPR screening datasets recently published were used (Shalem et al. (2014) *Science* 343:84-87; Wang et al. (2015) *Science* 350:1096-1101; Hart et al. (2015) *Cell* 163:1515-1526). The first dataset (Hart et al. (2015) *Cell* 163:1515-1526) includes screens of cells from colorectal carcinoma (DLD1 and HCT116), patient-derived glioblastoma (GBM), cervical carcinoma (HELA) and retinal epithelium (HELA). The second dataset performs screens on leukemia cell lines (KBM7, K562, JIYOYE, RAJI) (Wang et al. (2015) *Science* 350:1096-1101), and the third dataset is based on one melanoma cell line (A375) (Shalem et al. (2014) *Science* 343:84-87). For each dataset, MAGeCK-VISPR was used to calculate the β scores of all genes. Breast cancer specific essential genes are those that (1) are negatively selected in breast cancer cell lines and (2) have stronger negative selection values in breast cancer cell lines compared with non-breast cancer cell lines. Therefore, for each gene, its breast cancer specific essential score $SE_g$ was defined as $$SE_g = \log(\text{rank}(ts)) + \log(\text{rank}(\text{mean}(\beta_{BC})))$$

where is is the t-statistics tested on the β scores of two-groups: breast cancer cells (BC) and non-breast cancer cells (NBC), rank(•) is the rank function (converted to uniform distributed values between [0,1]). A lower SE score indicates this gene is an essential gene in breast cancer cells (smaller mean($\beta_{BC}$)), and is more essential in breast cancer cell lines compared with non-breast cancer cell lines (smaller ts). The p values are calculated from the null distribution of rank product statistics as described before (Breitling et al. (2004) *FEBS Lett.* 573:83-92; Eisinga et al. (2013) *FEBS Lett.* 587:677-682). Multiple comparison correction of the p values is performed using the Benjamini-Hochberg method (Benjamini et al. (2001) *Behav. Brain Res.* 125:279-284).

Figure 2:
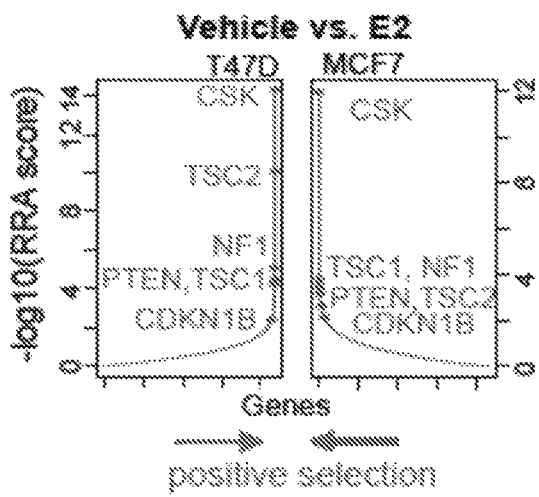
FIG. 2 includes 5 panels, identified as panels A, B, C, D, and E, which show that CSK mediates hormone independent breast cancer cell growth. CSK is positively selected in vehicle treated conditions compared with E2 treated conditions in both T47D and MCF7 cell lines (Panel A). The Robust Rank Aggregation (RRA) scores by comparing vehicle vs. E2 conditions from MAGeCK (Li, W et al. (2014) *Genome Biol.* 15:554) are shown. A smaller RRA score indicates a stronger negative selection. Knocking out of CSK in T47D and MCF7 cells by three different gRNAs result in hormone independent growth, while the cells infected with AAVS1_gRNA (control) cannot grow in the hormone-depleted medium (Panel B). And expression of three gRNA-resistant CSK cDNAs in these CSK-null cells fully rescues the growth phenotype (cell growth by crystal violet staining assays is shown. All of the cells were cultured in hormone-depleted medium) Immunoblot analysis for indicated proteins of control (gAAVS1), CSK-null and rescued CSK-null cells. GAPDH was used as a loading control. The ER ChIP-seq, as well as DNA hypersensitivity (DNase-I) and H3K27ac signals on the proximal region of CSK (Panel C). A zoom-in view of the enhancer regions on the upstream of CSK. The positions of 6 gRNA positions targeting this putative enhancer are also shown (Panel D). Knocking out ER binding sites decreases CSK expression, while knocking out the flanking regions has no effect on CSK expression (Panel E). The relative gene expression was measured by qRT-PCR after normalizing to the amount of GAPDH signal (mean±SD, for n=3).
Figure 2:
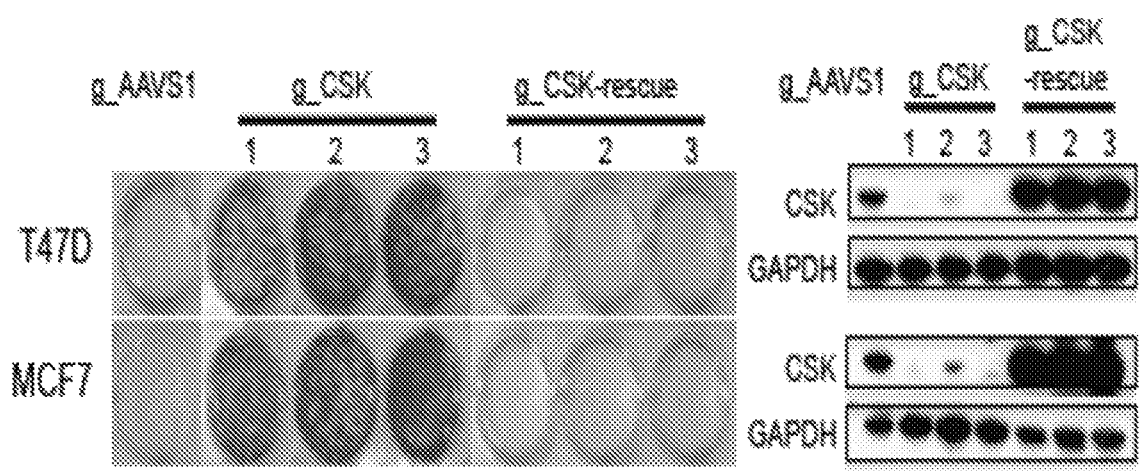
Figure 2:
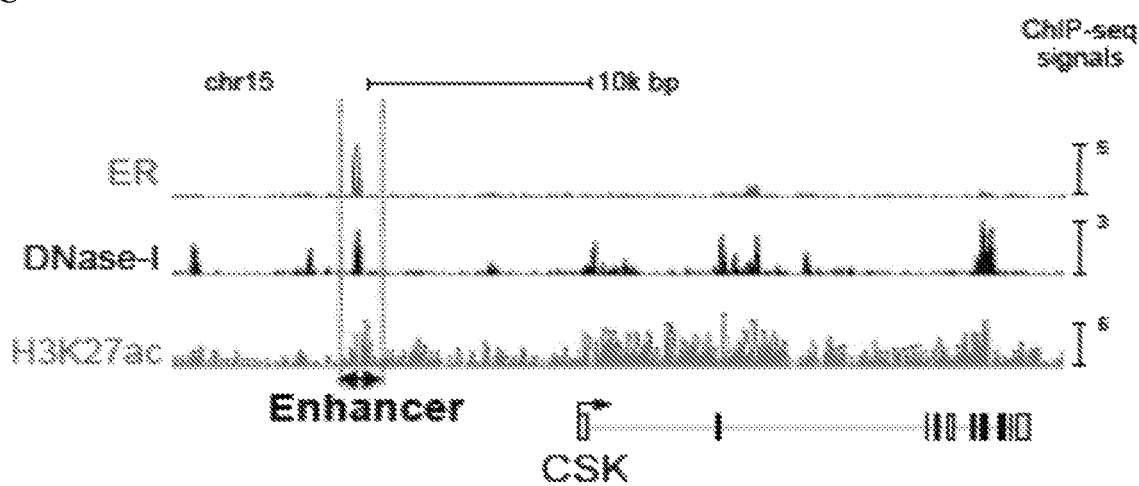
Figure 2:
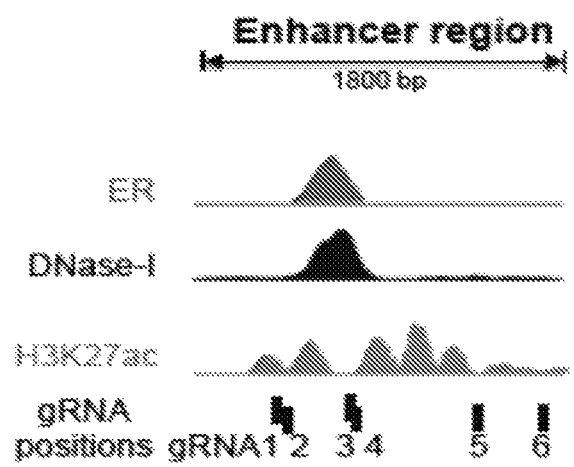
Figure 2:
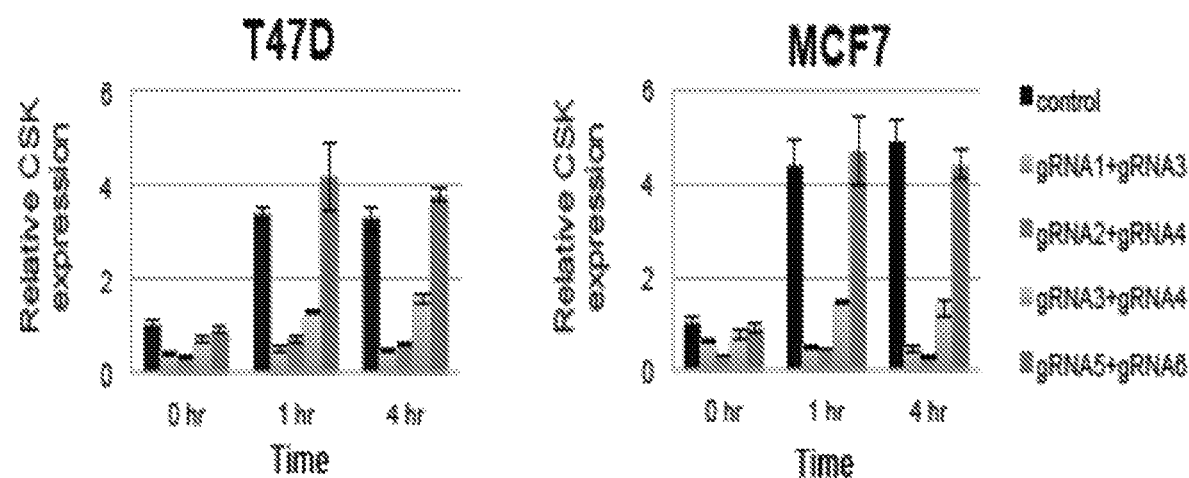

MAGeCK (Li, W et al. (2014) *Genome Biol.* 15:554) was used to identify genes whose knockout lead to stronger positive selection in vehicle compared with E2 conditions in T47D and MCF7 cells (FIG. 2, Panel A, Table 5). The MAGeCK algorithm works as follows. It first collects read counts of all gRNAs in all conditions from fastq files, and then normalizes the read counts of control and treatment conditions using median normalization. After that, MAGeCK builds a linear model to estimate the variance of gRNA read counts, evaluate the gRNA abundance changes between control and treatment conditions, and assigns a p-value using the Negative Binomial (NB) model. Finally, the selection of genes is evaluated from the rankings of gRNAs (by their p-values) using the α-RRA (α-Robust Rank Aggregation) algorithm. For each gene, α-RRA evaluates the rankings of all its gRNAs, and assigns a lower score (RRA score) if the distribution is more skewed compared with uniform distribution. The statistical significance of the RRA score is evaluated by permutation, and the Benjamini-Hochberg method is used for multiple comparison adjustments. To increase the statistical power, genes that have fewer than 4 gRNAs, or genes that have fewer than 2 significant gRNAs are excluded from the comparison. A detailed description of the MAGeCK algorithm can be found in the original study (Li, W et al. (2014) *Genome Biol.* 15:554).

e. Lentivirus Production and Purification

T-225 flasks of 293FT cells were cultured at 40%-50% confluence the day before transfection. Transfection was performed using Lipofectamine 2000 (Life Technologies). For each flask, 20 μg of lentivectors, 5 μg of pMD2.G, and 15 μg of psPAX2 (Addgene) were added into 4 ml OptiMEM (Life Technologies). 100 μl of Lipofectamine 2000 was diluted in 4 ml OptiMEM and, after 5 min, it was added to the plasmid mixture. The complete mixture was incubated for 20 min before being added to cells. After 6 h, the media was changed to 30 ml DMEM+10% FBS. After 60 h, the media was removed and centrifuged at 3,000 rpm at 4° C. for 10 min to pellet cell debris. The supernatant was filtered through a 0.45 μm low protein binding membrane. The virus was ultracentrifuged at 24,000 rpm for 2 h at 4° C. and then resuspended overnight at 4° C. in DMEM+10% FBS. Aliquots were stored at −80° C.

f. Real-Time RT-PCR

Real-time RT-PCR was performed as described before (Xiao et al. (2012) *RNA* 18:626-639). Data are presented as mean±standard deviation (SD). Primers used for RT-PCR are listed as follows (Table 16):

TABLE 16

| | |
|---|---|
| GGTGTGAACCATGAGAAGTATGA | GAPDH_qF1 |
| GAGTCCTTCCACGATACCAAAG | GAPDH_qR1 |
| CGGAATCCTTCTCTGGGAAATC | CSK_qF1 |
| CATCCATCTTGTAGCCCTTCTC | CSK_qR1 | g. Immunoblot

The western blotting was performed as described before (Xiao et al. (2015) *Stem Cell Reports* 5:856-865). Specific antibodies used include: anti-CSK (sc-286), anti-c-Src (sc-18), anti-p-c-Src Tyr530 (sc-101803), anti-p-c-Src Tyr 419 (sc-101802), anti-GAPDH (sc-25778) from Santa Cruz Biotechnology, anti-PAK2 (A301-264A) from Bethyl Lab, anti-p-PAK2 Ser141 (2606) from Cell Signaling technology.

h. Cell Proliferation Assays

The breast cancer cells were plated in 24-well plates ($4-5 \times 10^4$ cells/well) and kept under indicated conditions. The cells were trypsinized and collected. The number of viable cells was determined by Trypan blue exclusion and directly counted using a hemocytometer. Data represent means±SD from three independent replicates. P-values were calculated using unpaired Student's t-test.

i. ChIP-Seq

ChIP experiments for H3K27ac in T47D cells were performed as previously described (He et al. (2010) *Nat. Genet.* 42:343-347), and the antibody for H3K27ac was ab4729 (Abcam). Library construction was performed using the ChIP-seq DNA sample Prep Kit (Illumina) according to the manufacture's instruction; followed by high-througput sequencing with Illumina Hi-Seq.

j. RNA-Seq

The total RNAs were isolated by TRIzol (Invitrogen), followed by library construction using the TruSeq RNA Library Prep Kit (Illumina) for Illumina Hi-Seq.

k. Copy Number, Gene Expression and Epigenetics Profiling Analysis

The copy number variation (CNV) data from both T47D and MCF7 cells were downloaded from the Cancer Cell Line Encyclopedia (CCLE) (Barretina et al. (2012) *Nature* 483:603-607) project.

The gene expressions of CSK null and AAVS1 knockout T47D cells were quantified and analyzed from RNA-seq reads using Kallisto (Bray et al. (2016) Nat *Biotechnol.* 34(5):525-7) and DESeq2 (Love et al. (2014) *Genome Biol.* 15:550). The expression profiles in Cancer Cell Line Encyclopedia (CCLE) (Barretina et al. (2012) *Nature* 483:603-607) were used to compare between breast cancer and non-breast cancer cell lines (FIG. 1, Panel F). The processed gene expression values are downloaded directly from the CCLE website.

Several public epigenetics profiles in T47D cells in FIGS. 2D-2E were used, including genomic DNase-I footprints (Neph et al. (2012) *Nature* 489:83-90), ER ChIP-seq (Ross-Innes et al. (2012) *Nature* 481:389-393), FOXA1 ChIP-seq (Hurtado et al. (2011) *Nat. Genet.* 43:27-33) and GATA3 ChIP-seq (Gertz et al. (2013) *Mol. Cell* 52:25-36). The data from FOXA1 and GATA3 ChIP-seq are not shown (in FIG. 2) since there are no FOXA1/GATA3 bindings in the putative CSK enhancer. The raw reads of these studies (together with reads from H3K27ac ChIP-seq experiments) are first mapped to human hg38 reference genome using Bowtie2 (Langmead et al. (2012) *Nat. Methods* 9:357-359), and the peaks are identified using MACS2 (Zhang et al. (2008) *Genome Biol.* 9:R137).

l. Survival Analysis

The processed copy number variation (CNV) and gene expression data were downloaded directly from the META-BRIC study (Curtis et al. (2012) *Nature* 486:346-352). Besides, the gene expressions of breast cancer patients from two other cohorts were used (Symmans et al. (2010) *Journal of clinical oncology* 28:4111-4119; Ma et al. (2004) *Cancer Cell* 5:607-616). The R "survival" package was used for the survival analysis.

m. Network Analysis

Figure 4:
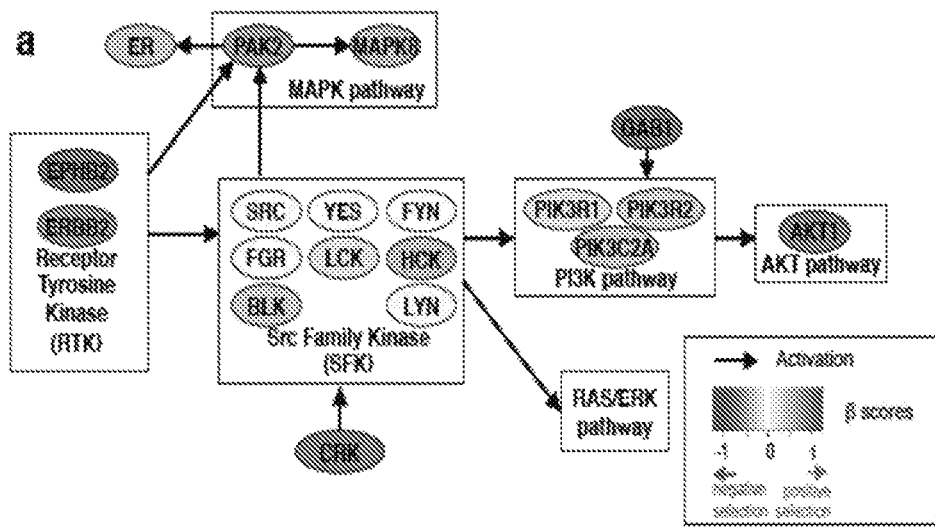
FIG. 4 includes 6 panels, identified as panels A, B, C, D, E, and F, which show PAK2 is synthetic lethal to CSK loss. The essentialities of genes in the SFK and associated pathways, measured by β scores from CRISPR screens, in CSK-null cells (Panel A). Genes are colored based on their β scores. Several genes in the SFK associated pathways are found to be essential, while SFK members are not essential. PAK2 targeting gRNAs reduce cell viability in T47D CSK-null cells, but not in control (AAVS1) cells (mean±SD, for n=3) (Panel B). The immunoblot analysis indicated proteins of PAK2 and CSK upon control (AAVS1) and CSK-null cells. GAPDH was used as a loading control (Panel C). Doxycycline induced expressions and relative cell viabilities of PAK2 with different mutants on tyrosine sites (Y130F, Y139F, Y194F), as well as wild-type PAK2 (mean±SD, for n=3, **$p<0.01$) (Panel D). All of the cells were cultured in hormone-depleted medium, and GAPDH was used as a loading control. The immunoblot analysis indicated proteins of autophosphorylation sites of PAK2 and SFK as well as total proteins of CSK, SFK and PAK2 upon CSK knockout and rescue (Panel E). The expressions of PAK2 and PAK2$^{S141}$ upon treatments of two SFK inhibitors Dasatinib and Saracatinib in the CSK-null cells for 1 h, 3 h and 6 h (Panel F). The term "ctrl" denotes the CSK-null cells with vehicle treatment for 6 hours.
Figure 4:
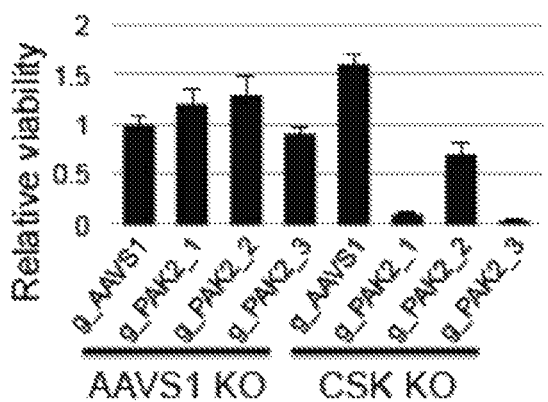
Figure 4:
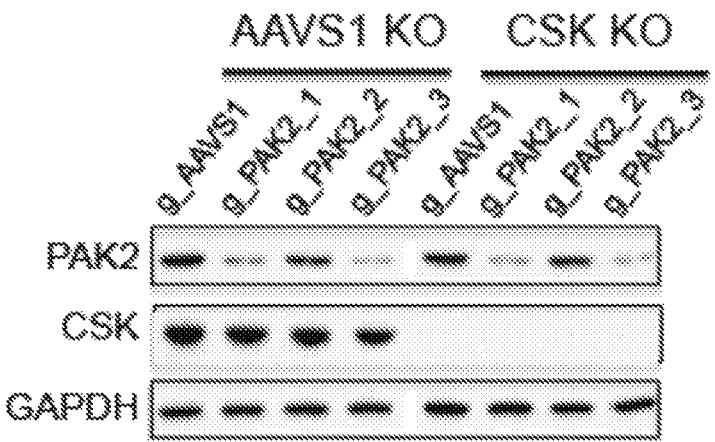
Figure 4:
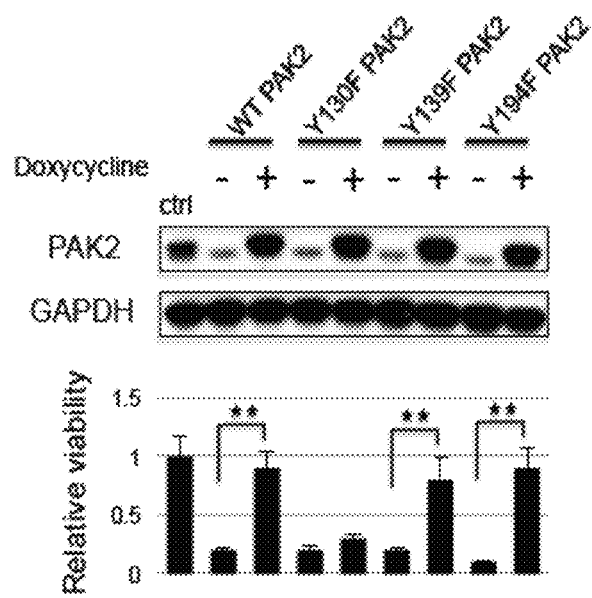
Figure 4:
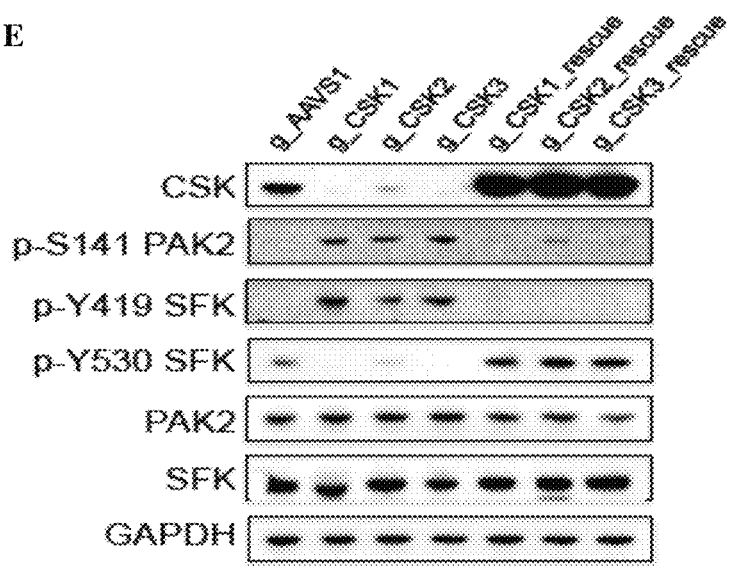
Figure 4:
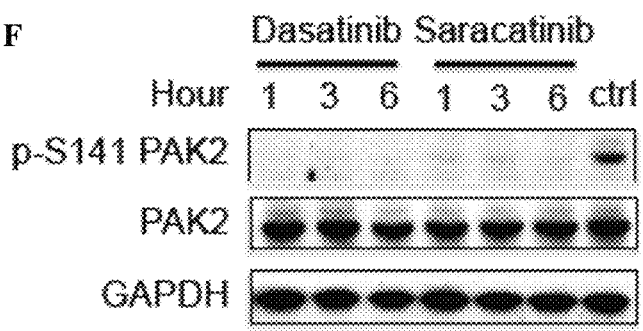

GeneMania (Warde-Farley et al. (2010) *Nucleic Acids Res.* 38:W214-20) was used to construct the network of primary screens (FIG. 1, Panel C, FIG. 10) and CSK synthetic lethal gene network (FIG. 4, Panel A, FIGS. 18 and 19). In GeneMania, different networks collected from public datasets, including co-localization, genetic interaction, pathway, physical interaction, and shared protein domain networks are used to connect genes. Network construction was performed through GeneMania CytoScape plugin (Montojo et al. (2010) *Bioinformatics* 26:2927-2928), while the networks are visualized using Cytoscape (Shannon et al. (2003) *Genome Res.* 13:2498-2504).

Figure 6:
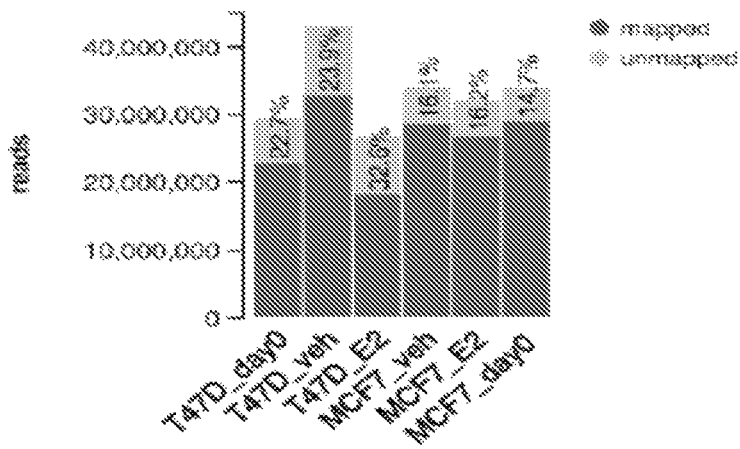
FIG. 6 includes 5 panels, identified as panels A, B, C, D, and E, which show the quality control measurements of T47D and MCF7 CRISPR screens, including total reads and the percentage of unmapped reads (Panel A), the number of missed gRNAs (Panel B), the Gini-index of read count distribution (Panel C), the distribution of normalized reads (Panel D), as well as sample correlation and clustering results (Panel E). All measurements are generated from MAGeCK-VISPR (Li, W et al. (2015) *Genome Biol.* 16:281).
Figure 6:
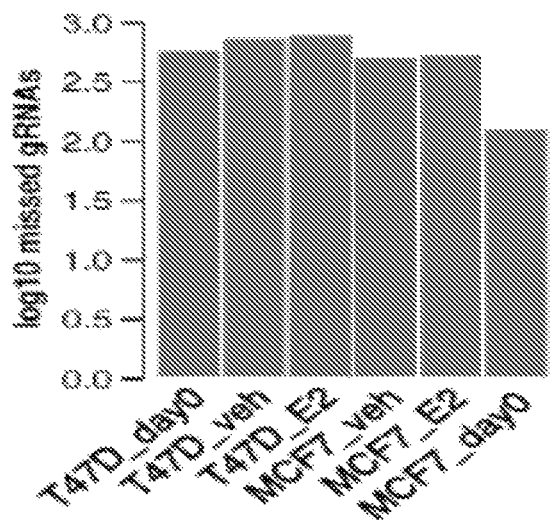
Figure 6:
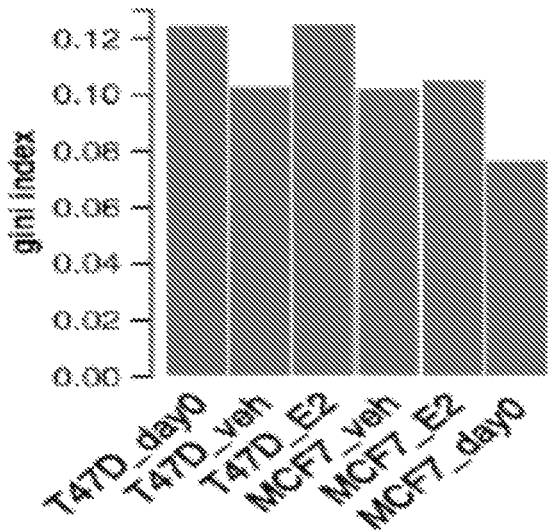
Figure 6:
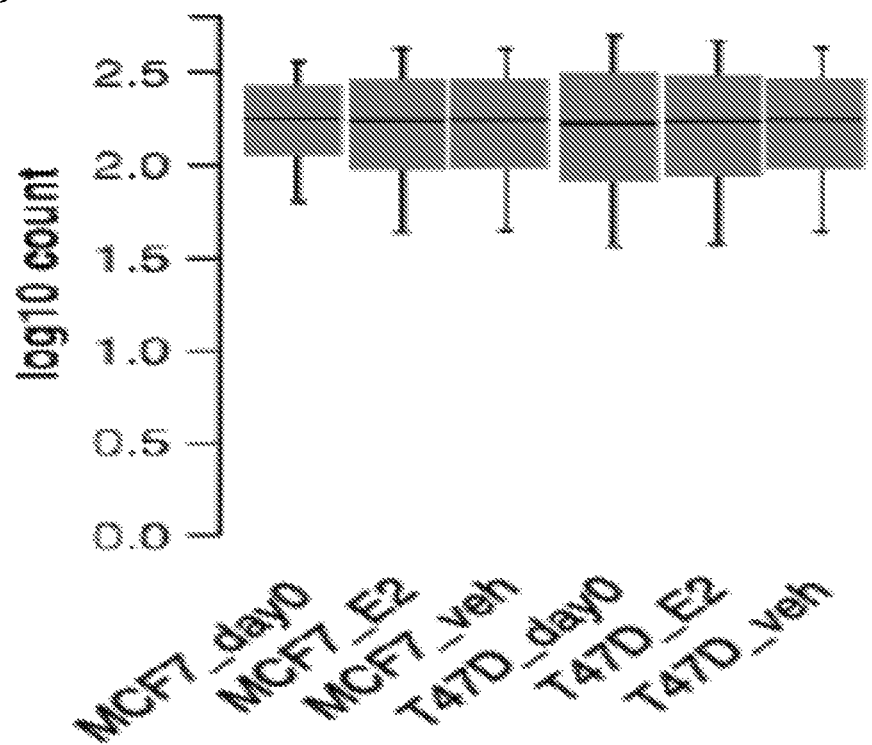
Figure 6:
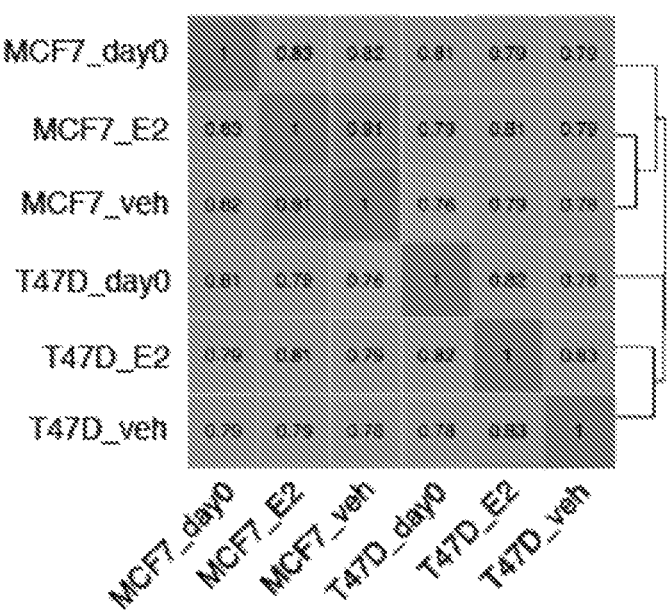
Figure 7:
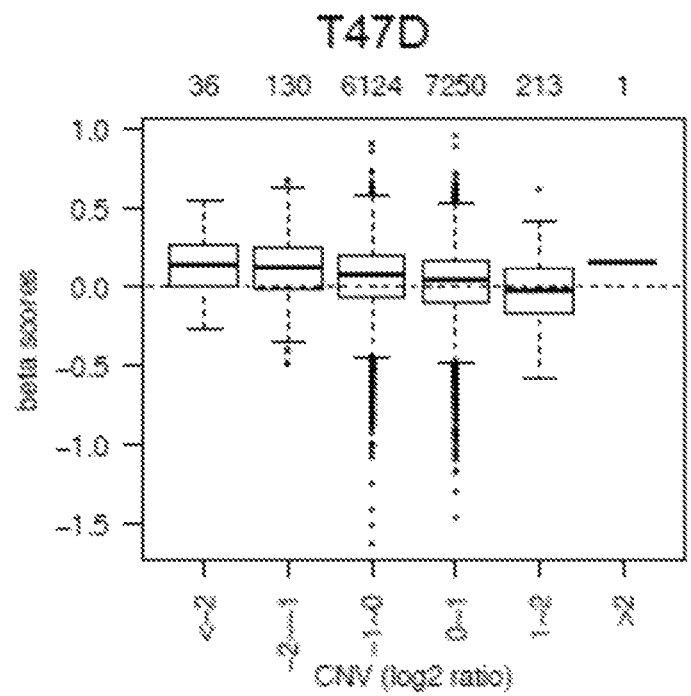
FIG. 7 includes 4 panels, identified as panels A, B, C, and D, which show copy number variations (CNV) affect screening results in MCF7, but not in T47D. The CNV measurements (measured in log 2 ration) and beta scores of all genes in the chromosome 17 of T47D and MCF7 cells (Panels A and B). The distributions of beta scores of all genes, grouped by the copy number status of the gene (Panels C and D).
Figure 7:
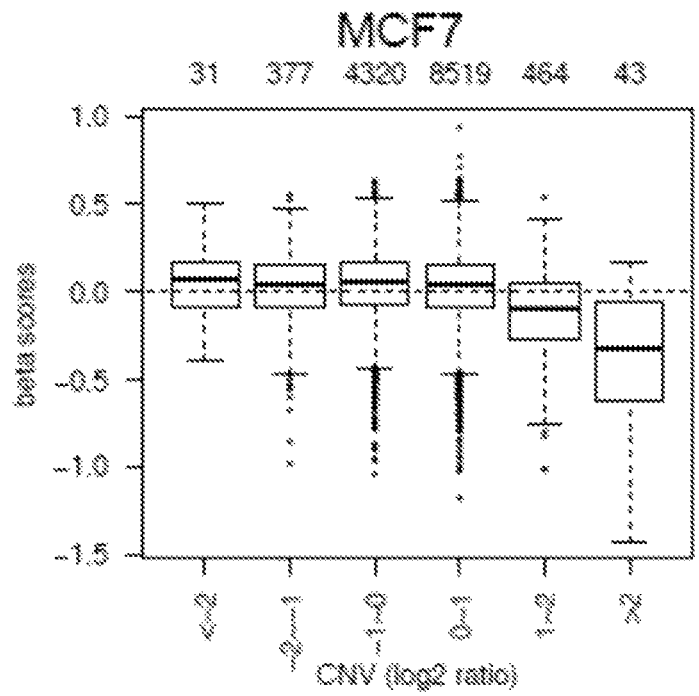
Figure 7:
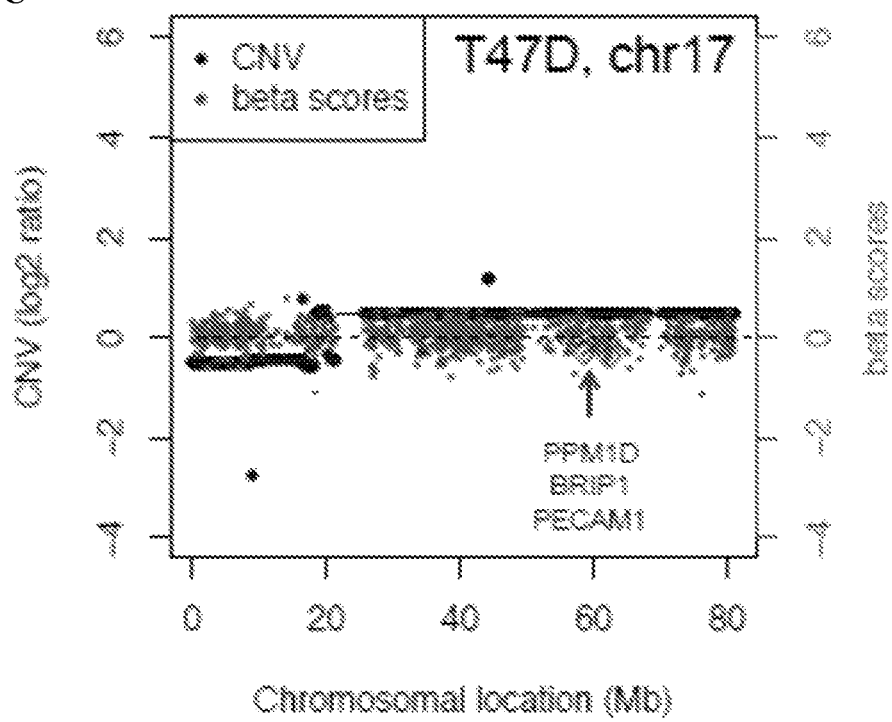
Figure 7:
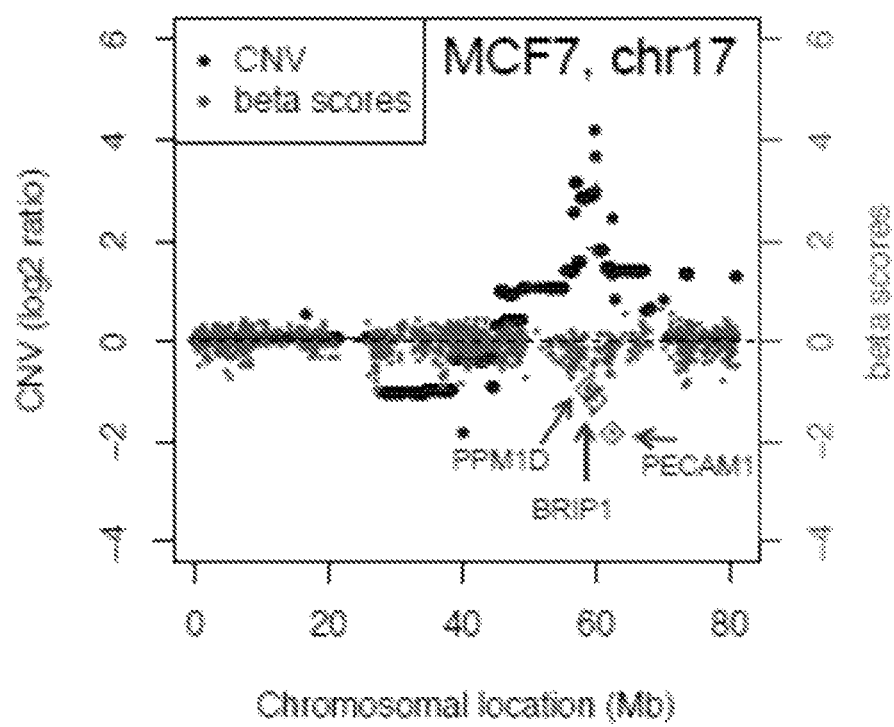
Figure 8:
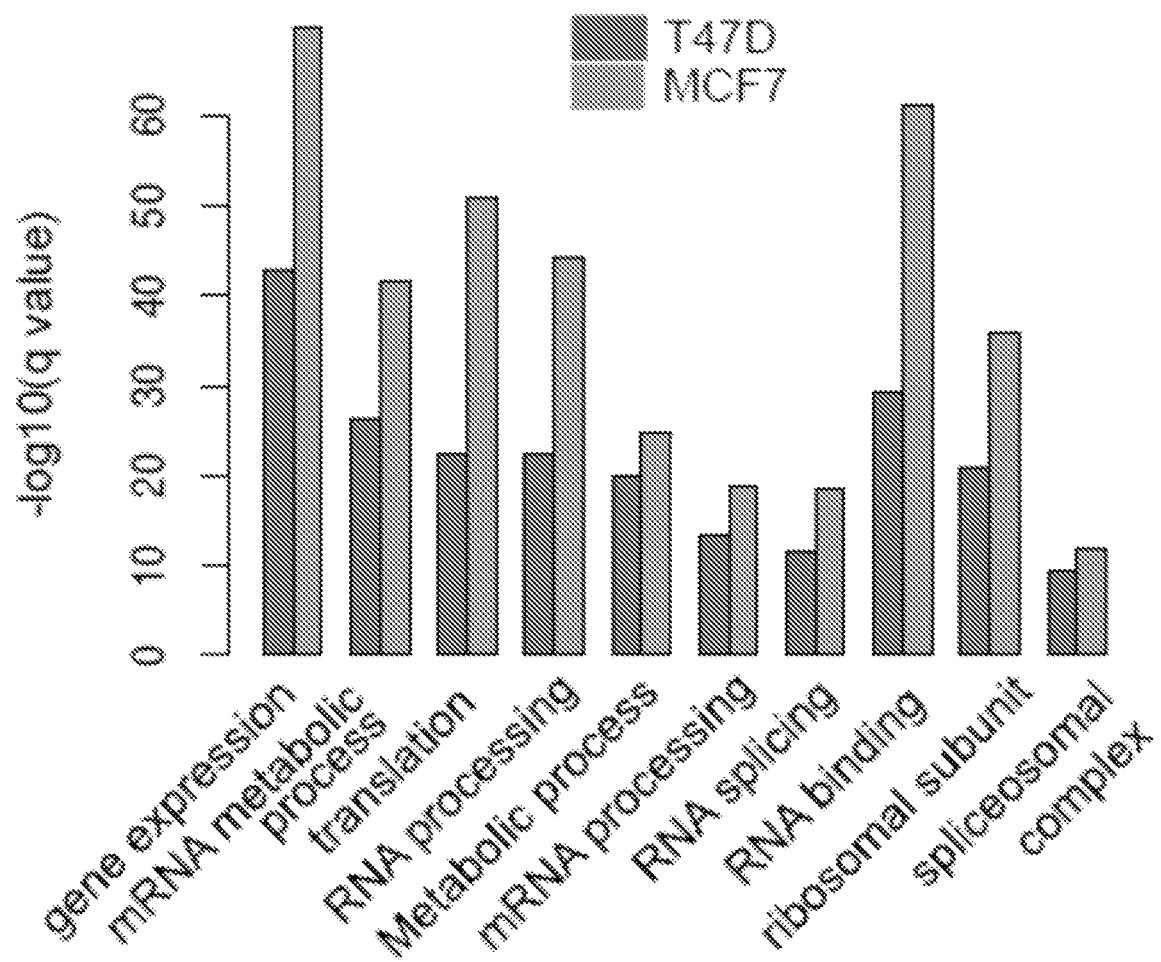
FIG. 8 shows enriched Gene Ontology (GO) terms in negatively selected genes. The functional enrichment is analyzed using Gorilla (Montojo et al. (2010) *Bioinformatics* 26:2927-2928).

Example 2: Genome-Wide CRISPR Screens Identified ER+ Breast Cancer Specific Essential Genes To systematically investigate genes whose loss affects cell viability or potentiates the estrogen-independent growth of ER+ breast cancer cells, genome-wide CRISPR/Cas9 knockout screens were performed in ER+ breast cancer cell lines MCF7 and T47D using the GeCKO v2 library (Sanjana et al. (2014) *Nat. Methods* 11:783-784). After infection with the lentiviral guide RNA (gRNA) library and selection by puromycin, the cells were cultured in hormone-depleted medium and treated with either estrogen (17β estradiol or E2) or vehicle control (Veh) over four weeks (FIG. 1, Panel A). The sequences encoding the gRNA were PCR amplified from the transduced cells at Day 0 and after 4 weeks of culture and quantified by high-throughput sequencing (FIG. 6). Negatively and positively selected genes were identified by calculating the gene essentiality score using MAGeCK-VISPR, a statistical algorithm previously developed for CRISPR screen analyses (Li, W et al. (2014) *Genome Biol.* 15:554; Li, W et al. (2015) *Genome Biol.* 16:281). MAGeCK-VISPR compared the gRNA abundance of all the gRNAs targeting a gene across different conditions and assigned each gene a "β" score of essentiality in each condition compared with the controls. A positive (or negative) β score indicated the corresponding gene was under positive (or negative) selection in the CRISPR screen. Overall, a high correlation was found between the sets of positively or negatively selected genes in the two cell lines (FIG. 1, Panel B). Consistent with recent work from others, it was found that some of the differences between the two cell lines may be due to cell-line specific copy number variations (Wang et al. (2015) *Science* 350:1096-1101) (FIG. 7, Panels A-B). For example, three genes (BRIP1, PECAM1 and PPM1D) were strongly negative selected in MCF7 cells, but not in T47D cells. These genes were all transcribed from a Ch17q23.2 locus, which was amplified more than 17 fold in MCF7 cells, but not in T47D (FIG. 7, Panels C and D). Overall, gRNAs for known driver genes for ER+ breast cancers (Mehra et al. (2005) *Cancer Res.* 65:11259-11264; Lupien et al. (2008) *Cell* 132:958-970), such as ER (or ESR1), GATA3, FOXA1, and MYC, are strongly depleted (FIG. 1, Panels B and C), while gRNAs for tumor suppressors, such as such as NF1, TSC1, TSC2, and PTEN, are strongly enriched (FIG. 1, Panel B). The essential genes are enriched in many fundamental biological processes, such as gene expression, RNA processing, and translation (FIG. 1, Panel C, FIG. 8).

Figure 9:
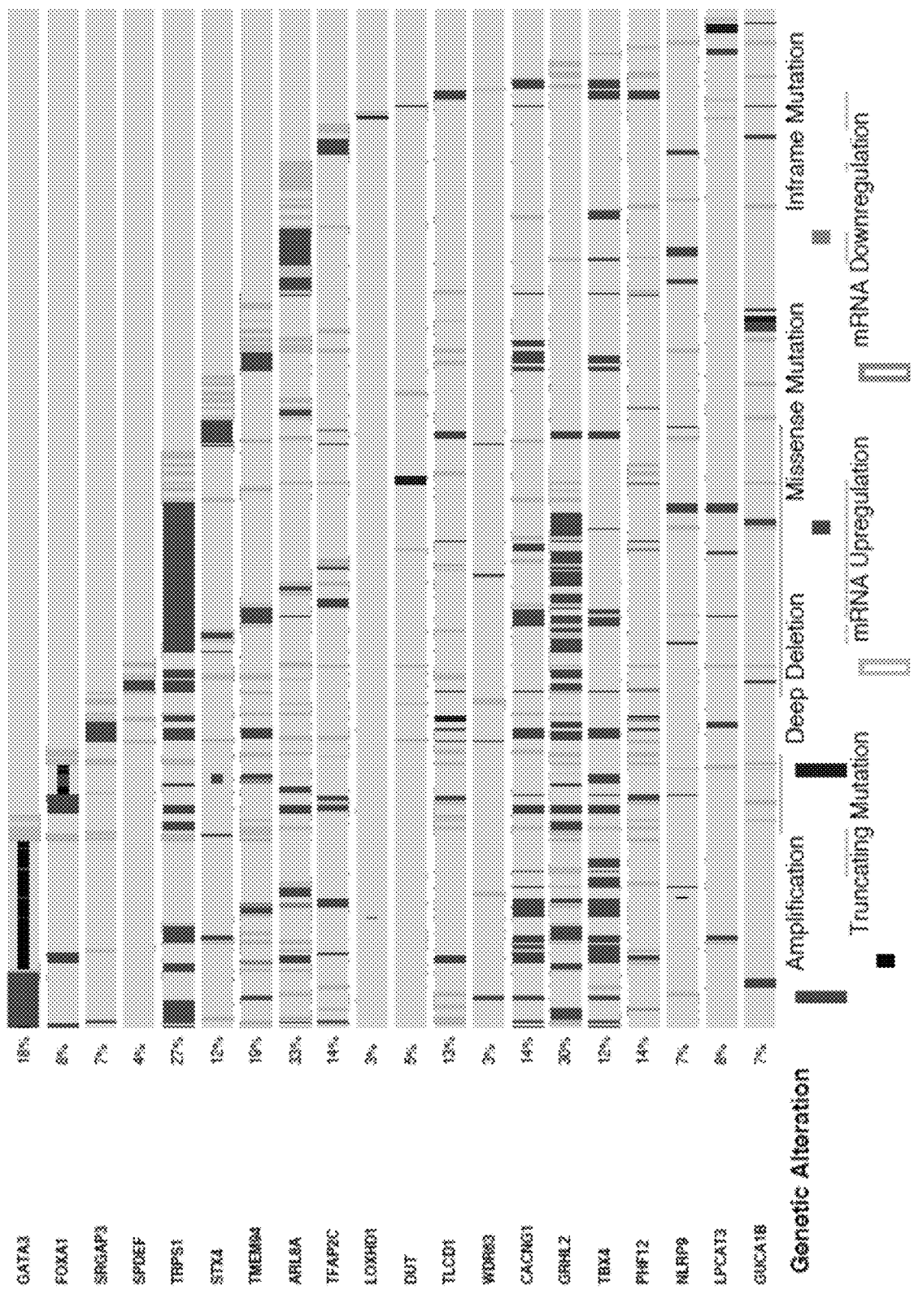
FIG. 9 includes 2 panels, identified as panels A and B, which show clinical associations of breast cancer specific essential genes. Genetic alterations of top 20 breast cancer specific essential genes in TCGA breast cancer dataset (Panel A) (Koboldt et al. (2012) *Nature* 490:61-70). Alterations of TRPS1 and GRHL2 predicts worse clinical outcome. Data is downloaded and visualized from cBioPortal (Panel B) (Gao et al. (2013) *Sci. Signal* 6:11-11).
Figure 9:
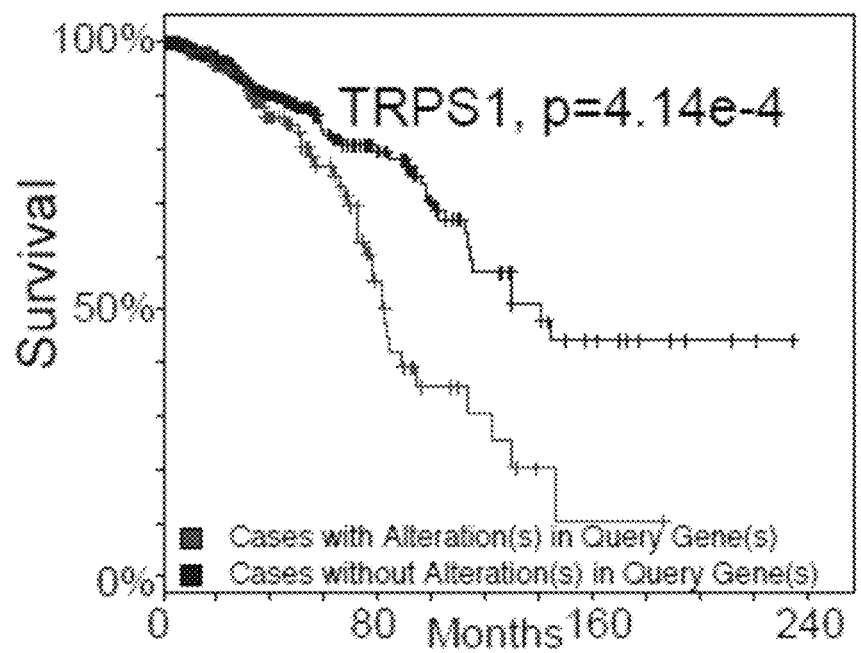
Figure 9:
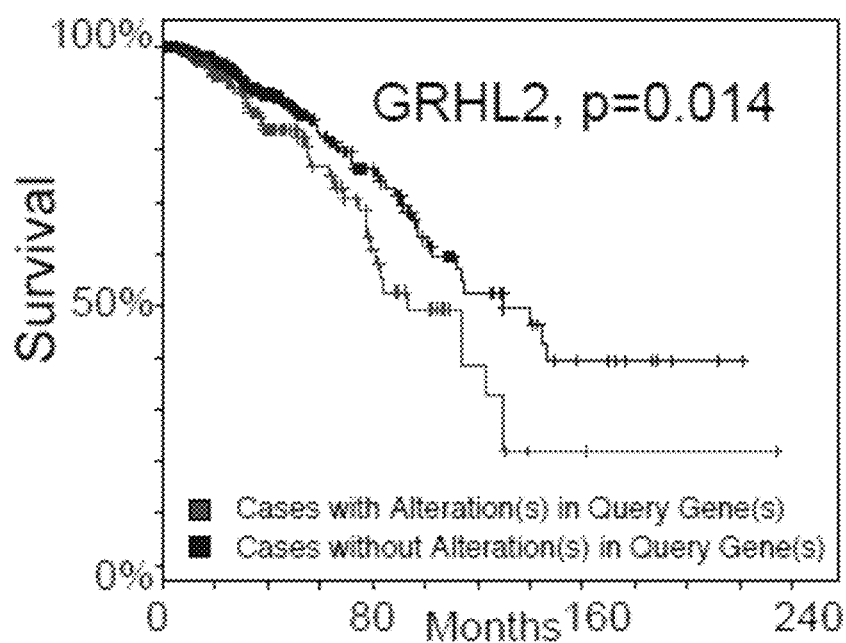
Figure 10:
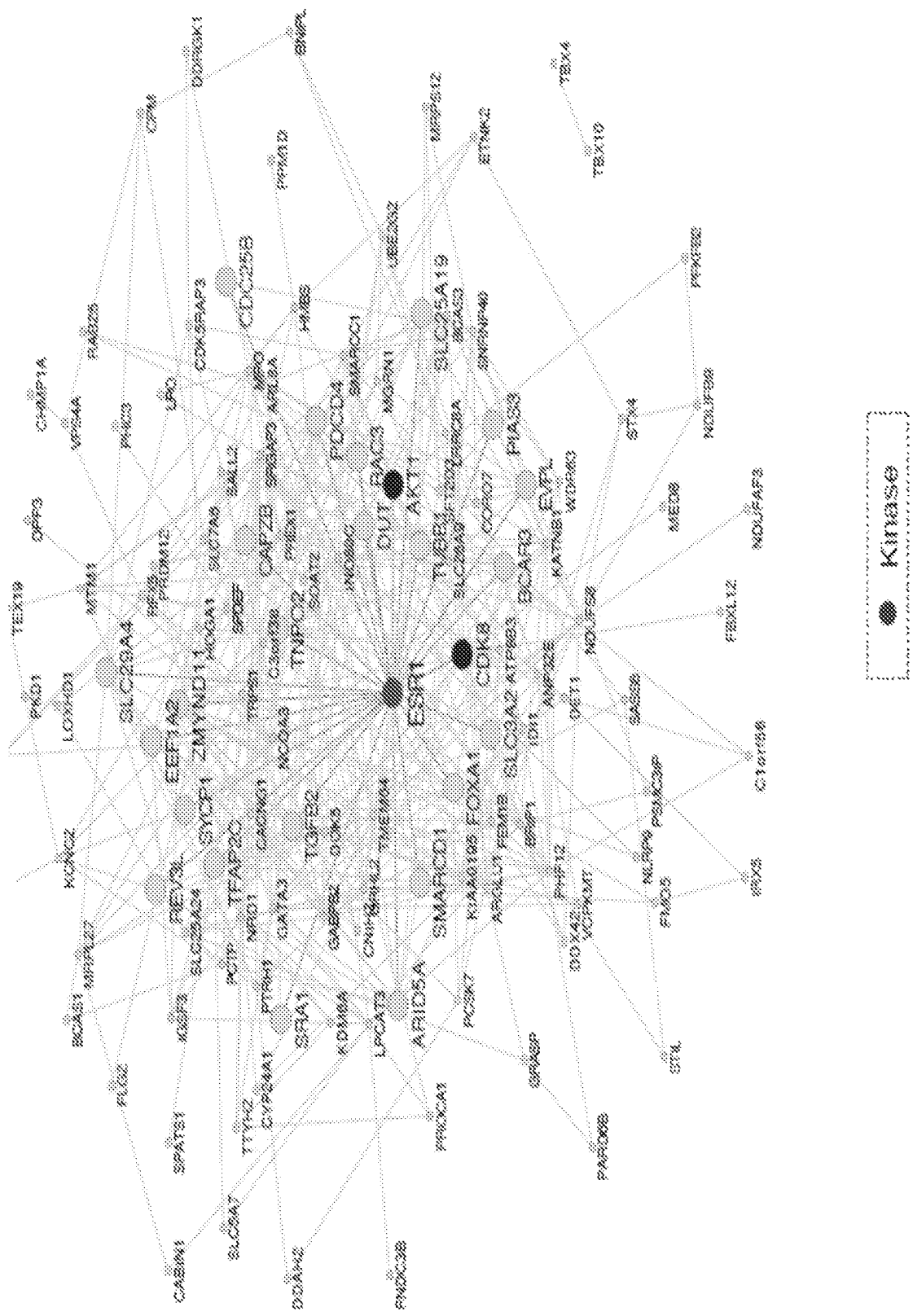
FIG. 10 shows a network view of 149 breast cancer specific essential genes. Dots represent essential genes, and edges indicate two genes have genetic, physical interactions, are co-localized, or are in the same pathway. The network is extracted from GeneMANIA(Warde-Farley et al. (2010) *Nucleic Acids Res.* 38:W214-20). Kinases are marked as blue, and genes connected with ER are highlighted.

It was next sought to identify genes that are specifically essential in ER+ breast cancer cells, as these genes may serve as therapeutic targets. Public genome-wide CRISPR screen data were collected from 10 cell lines representing 6 different cell types (colorectal carcinoma, glioblastoma, cervical carcinoma, retinal epithelium, melanoma and leukemia) (Shalem et al. (2014) *Science* 343:84-87; Wang et al. (2015) *Science* 350:1096-1101; Hart et al. (2015) *Cell* 163:1515-1526). A score was derived to identify breast cancer specific essential genes with stronger negative selection in breast cancer cells compared with the other cell types (see Materials and Methods for details). This approach identified approximately 150 statistically significant genes using a rank-product algorithm with specific essentiality in ER+ breast cancers (false discovery rate FDR≤0.05; FIG. 1, Panels D and E; Table 3). Overall, the ER+ breast cancer-specific essential genes tend to have higher expression in T47D and MCF7 cells compared with the other cell lines (FIG. 1, Panel F), are amplified or up-regulated in breast cancer patient samples (FIG. 9, Panels A and B), and are enriched in breast cancer related pathways (Table 4). Many of these genes have physical or genetic interactions with ER (FIG. 10), confirming the central role of ER in ER+ breast cancer cells. Interestingly, eight of the top twenty specific essential genes are transcription factors (GATA3, FOXA1, SPDEF, TRPS1, TFAP2C, GRHL2, TBX4, PHF12). Among these, FOXA1, GATA3, SPDEF and TFAP2C are known to interact with ER and exert critical functions in breast cancer (Carroll et al. (2005) *Cell* 122:33-43; Eeckhoute et al. (2007) *Cancer Res.* 67:6477-6483; Buchwalter et al. (2013) *Cancer Cell* 23:753-767; Kang et al. (2014) *Cancer Res.* 74: 1484-1494). TRPS1 and GRHL2 are also associated with breast cancer progression and have been implicated as oncogenes in ER+ breast cancers (Chen et al. (2011) *Horm Cancer* 2:132-143; Werner et al. (2013) *J. Biol. Chem.* 288:22993-23008; Xiang et al. (2012) *PLoS ONE* 7, e50781) (FIG. 9, Panel B). The identification of ER and the known components of the ER signaling pathway as well as other previously identified breast cancer oncogenes validate the robust nature of the screen.

Figure 11:
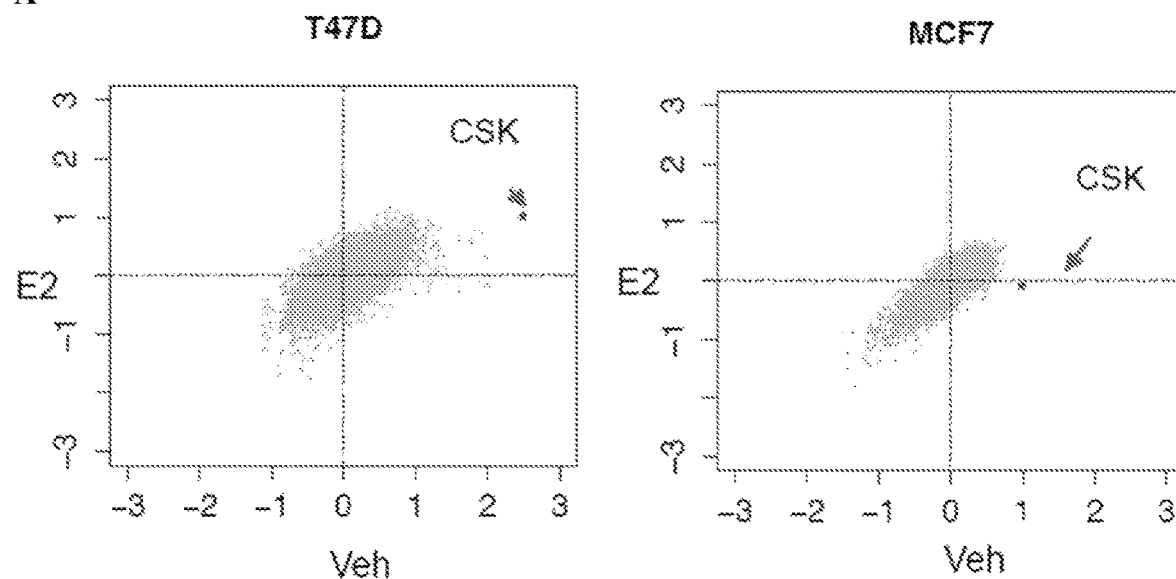
FIG. 11 includes 2 panels, identified as panels A and B, which show CSK regulates the growth of T47D and MCF7. CSK shows positively selected in vehicle treated conditions compared with E2 treated conditions in both T47D and MCF7 cell lines (Panel A). The β scores of all genes in two conditions (vehicle and E2) are shown. The normalized read counts of gRNAs targeting CSK in two cell lines (Panel B).
Figure 11:
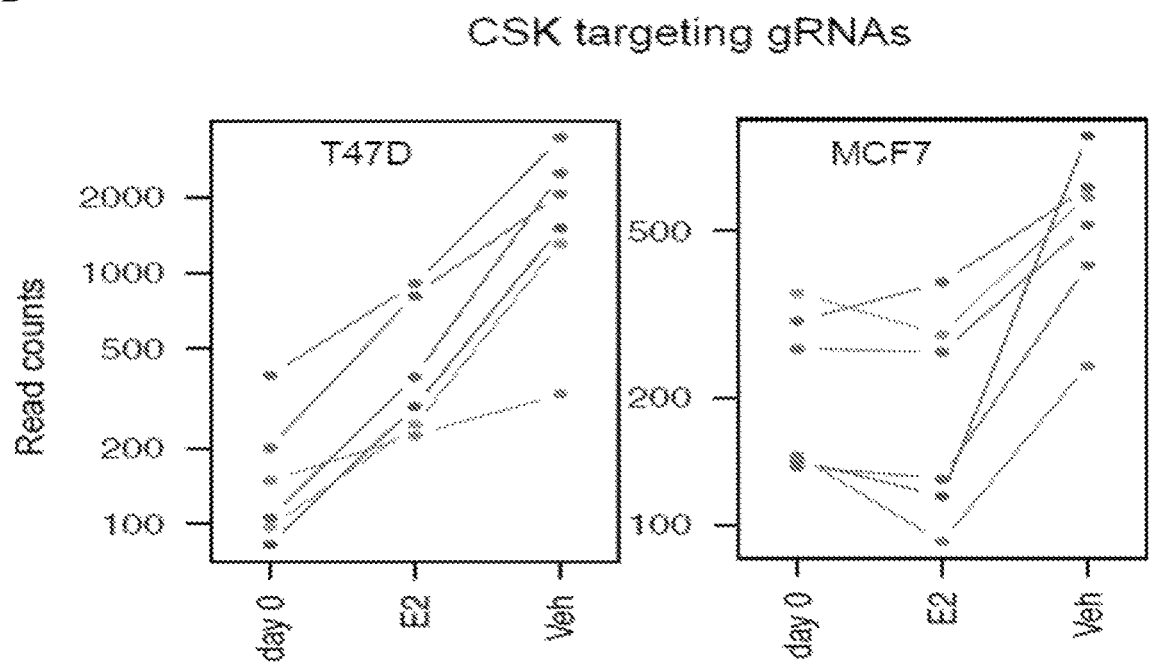

Example 3: The ER Regulated C-Src Tyrosine Kinase (CSK) Mediates Endocrine Resistance Key genes were next searched that drive estrogen-independent growth by finding genes with a stronger positive selection in the Veh compared with the E2 condition (see Materials and Methods). The hit list (Table 5) includes several known tumor suppressor genes, including NF2, TSC2, LATS2, PTEN, as well as NF1 whose silencing has been previously reported to cause tamoxifen resistance (Mendes-Pereira et al. (2012) *Proc Natl Acad Sci USA* 109:2730-2735) (FIG. 2, Panel A). The strongest hit in both T47D and MCF7 cells is c-src tyrosine kinase (CSK), a negative regulator of Src family kinases (SFKs, FIG. 2, Panel A, FIG. 11, Panel A). All six CSK-targeting gRNAs in the GeCKO2 library are dramatically enriched in both MCF7 and T47D cells in the Veh versus E2 condition (FIG. 11, Panel B). Given its very significant positive CRISPR selection in both cell lines and its role in inhibiting the function of SRC and other oncogenic SFK (Okada et al. (2012) *Int. J. Biol. Sci.* 8:1385-1397), CSK was focused on for further analysis.

Figure 12:
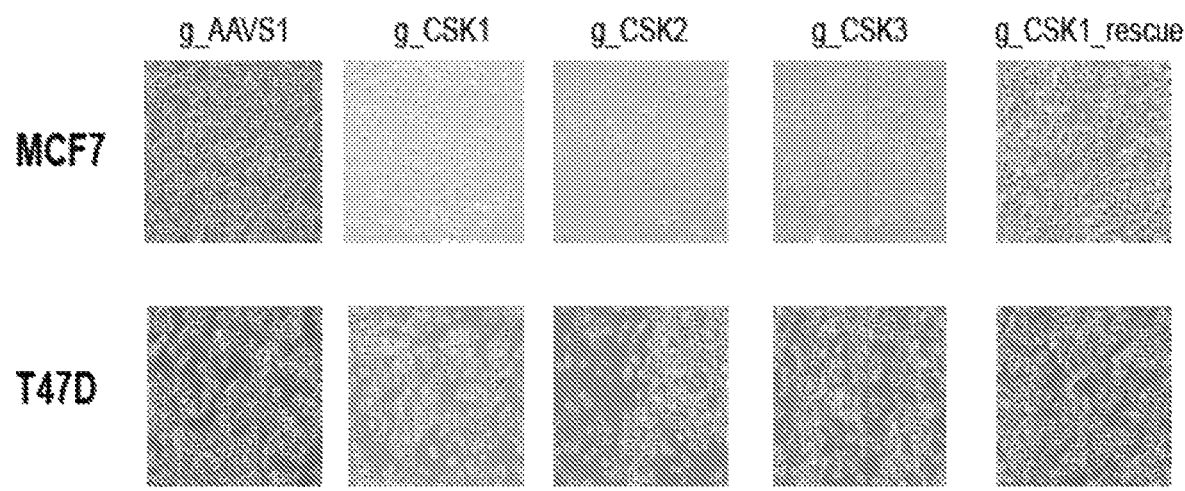
FIG. 12 shows the morphology change of cell shapes after knocking out CSK in T47D and MCF7 cells. Rescuing CSK expression recovers the original cell shapes in both cell lines.

First, to validate that CSK knockout confers hormone independent growth, three different gRNAs were introduced targeting CSK (one from the GeCKO2 library and two newly designed) and a control gRNA targeting the AAVS1 safe-harbor locus into T47D and MCF7 cells. All three CSK-targeting gRNAs suppressed CSK protein expression and stimulated cell growth in the absence of E2 (FIG. 2, Panel B). This estrogen independent growth could be fully reversed by the overexpression of a human CSK cDNA containing a PAM sequence mutation specific to each of the three CSK targeting gRNA to escape CRISPR/Cas9 cutting (FIG. 2, Panel B). In addition to E2 independent growth, deletion of CSK induced a striking sickle-like morphology in both cell lines suggesting a more invasive phenotype (Yin, Z et al. (2013) *Nat. Cell Biol.* 15:860-871) (FIG. 12). The phenotypic changes in these CSK-null cells could likewise be fully reversed by the overexpression of the CRISPR/Cas9 resistant CSK cDNAs (FIG. 12).

Figure 13:
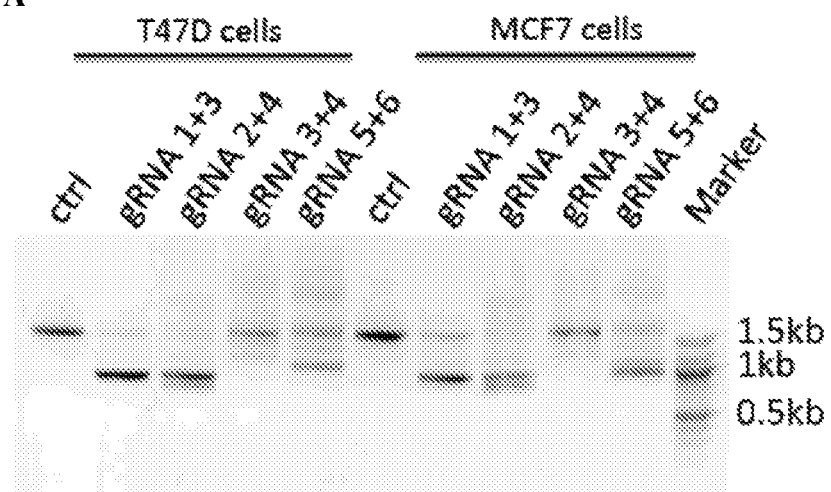
FIG. 13 includes 2 panels, identified as panels A and B, which show CRISPR-out CSK enhancer. The knockout efficiency of CSK enhancer deletions (Panel A). The effects of deleting enhancers and flanking regions on cell growth (Panel B). Cell growth by crystal violet staining assays is shown. All of the cells were cultured in hormone-depleted medium.
Figure 13:
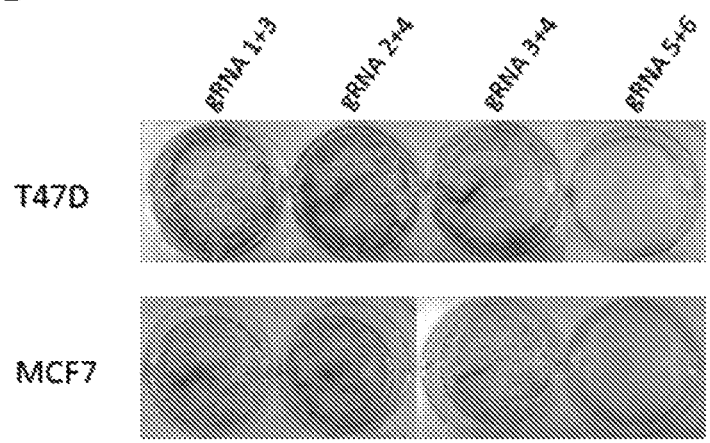

As CSK was differentially selected between Veh and E2 conditions, it was next asked whether ER regulated CSK expression. Examination of ER and H3K27ac ChIP-seq and DNase-seq data revealed a putative ER bound enhancer approximately 10 kb upstream of CSK transcription start site (FIG. 2, Panel C). This region contains an ER binding site as well as an ER DNA binding motif. To test whether ER activates CSK through this putative enhancer, three pairs of gRNAs were introduced together with Cas9 to fully or partially delete the putative enhancer, and one pair of gRNAs together with Cas9 targeting a flanking region away from the enhancer as a control (FIG. 2, Panels D and E). In the absence of Cas9/gRNA transfection, CSK expression is strongly up-regulated upon E2 treatment. This activation is abrogated when the enhancer is disrupted, while deletion of the flanking region did not affect CSK expression (FIG. 2, Panel E, FIG. 13, Panel A). Moreover, the deleted enhancer but not the flanking region confers hormone independent growth of the cells, indicating that this enhancer region is required for the ER regulation of CSK (FIG. 13, Panel B).

Example 4: Growth Factor and ER Signaling Changes Induced by CSK Loss

Figure 3:
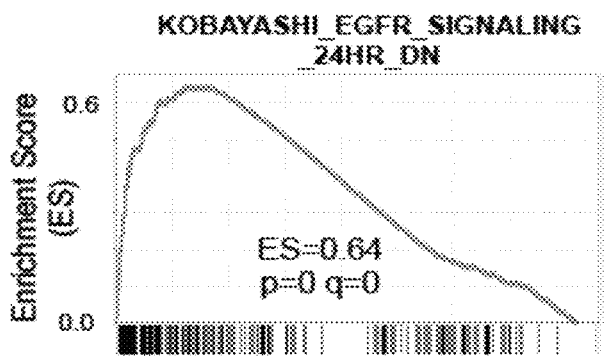
FIG. 3 includes 3 panels, identified as panels A, B, and C, which show growth factor and ER signaling changes induced by CSK loss. Gene Set Expression Analysis (GSEA) identified EGFR gene signatures are up-regulated upon CSK loss in T47D cells (Panel A). Genes in the EGFR signature (black bars) are ranked based on their differential expression between CSK-null and CSK-wt cells, and the Enrichment Score (ES) from GSEA for each gene is plotted. Effects of CSK knockout on sensitivity to two ER antagonist tamoxifen and fulvestrant in T47D and MCF7 cells (Panels B and C). Relative cell viability of control (AAVS1) and CSK-null cells after treatment with indicated compound concentrations for 5 days are shown (mean±SD, for n=3). The control cells were cultured in hormone-depleted medium plus E2 (10 nM) and the CSK-null cells were cultured in hormone-depleted medium plus vehicle.
Figure 3:
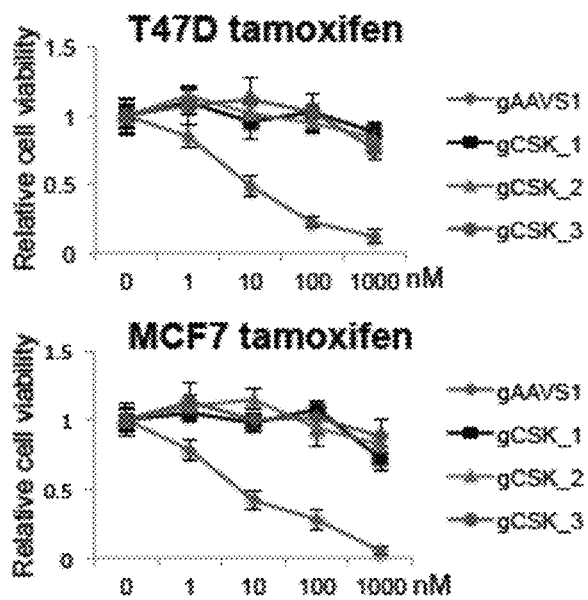
Figure 3:
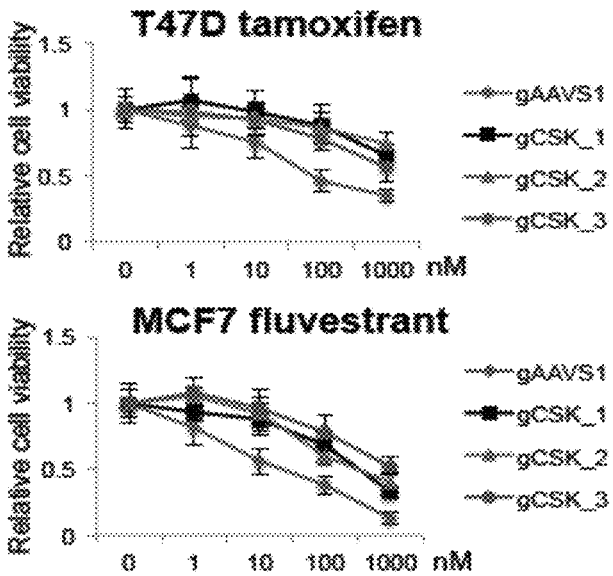
Figure 14:
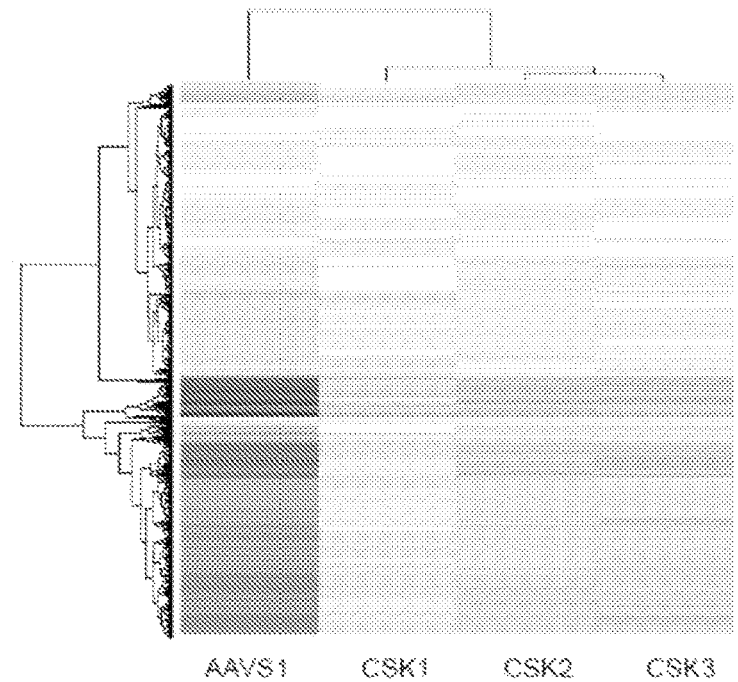
FIG. 14 includes 2 panels, identified as panels A and B, which show gene expression changes upon CSK knockout. The expression patterns of 6536 differentially expressed gene (FDR=1e-5) between T47D CSK-null and wild-type cells (Panel A). The expressions of genes are measured in Transcripts Per Million (TPM) from RNA-seq. The normalized expression of selected genes in control and CSK null cells (Panel B).
Figure 14:
Figure 14:
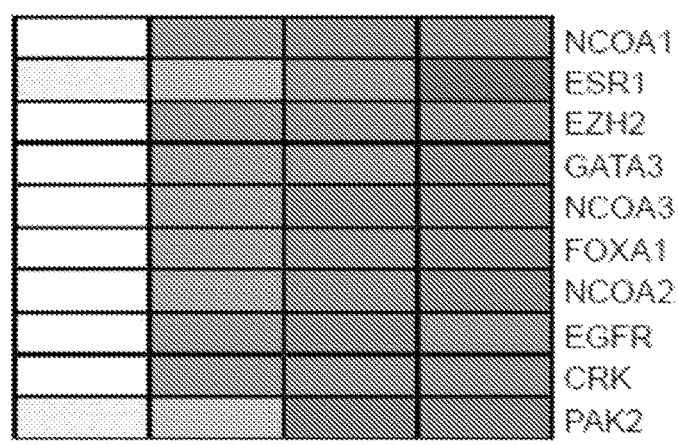
Figure 14:
Figure 14:
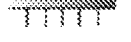
Figure 15:
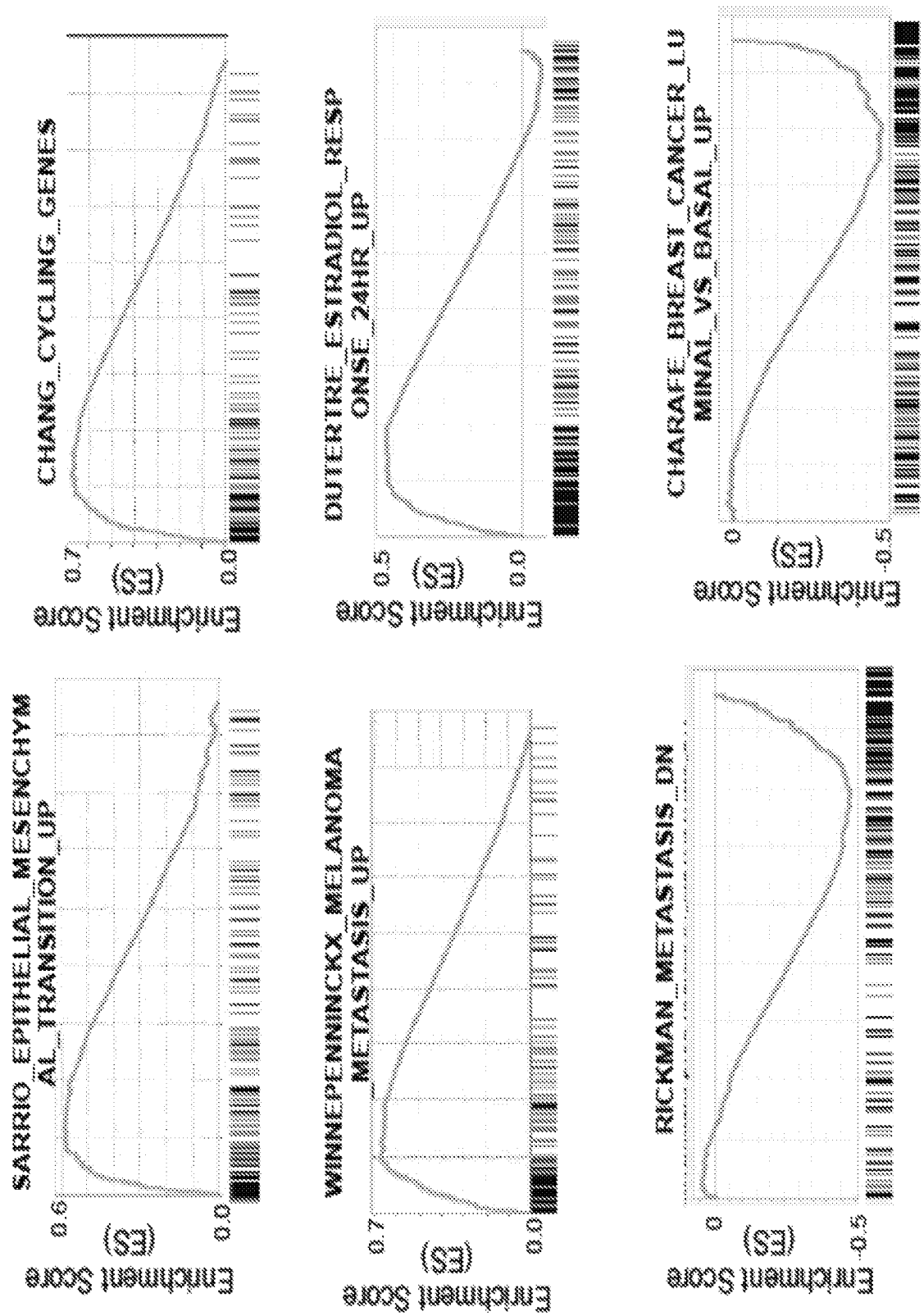
FIG. 15 shows enriched pathways in up- and down-regulated genes in CSK-null cells using Gene Set Enrichment Analysis (GSEA)

To understand how CSK loss leads to estrogen-independent growth of ER+ breast cancer cells, RNA-seq analysis was performed to find differentially expressed genes and pathways upon CSK loss in T47D cells. Loss of CSK led to global changes in gene expression (FIG. 14, Panel A, Table 6). Gene Set Enrichment Analysis (GSEA) showed EGFR signature genes, as well as other oncogenic pathways such as metastasis, cell cycle, epithelial-mesenchymal transition (EMT), to be significantly up-regulated after CSK loss (FIG. 3, Panel A, FIG. 15, Table 7). The expression of EGFR, whose over-expression can elicit tamoxifen resistance (Musgrove et al. (2009) *Nat. Rev. Cancer* 9:631-643), was also increased (FIG. 14, Panel B). These results suggest that CSK deletion activates several cancer-related pathways, which might contribute to the hormone independent growth of breast cancer cells. Interestingly, ER and several of its co-regulators and collaborating transcription factors were also found to be dramatically up-regulated upon CSK deletion (FIG. 14, Panel B), including GATA3, FOXA1, EZH2 and NCOA1/2/3 (Anzick et al. (1997) *Science* 277:965-968) suggesting the potential for ER to continue to play a role in CSK null cells. In order to probe the function of ER in this setting, the CSK-null T47D and MCF7 cells were treated with tamoxifen and fulvestrant, two ER antagonists approved for the treatment of ER+ breast cancer. Interestingly, the CSK-null cells were completely resistant to tamoxifen but remained partially sensitive to fulvestrant (FIG. 3, Panels B and C). It was previously shown that while tamoxifen is unable to prevent growth factor stimulated ER signaling, fulvestrant is able to fully inhibit ER action (Lupien et al. (2010) *Genes Dev.* 24:2219-2227). These results demonstrate that ER remains essential for estrogen independent growth induced by loss of CSK.

Figure 16:
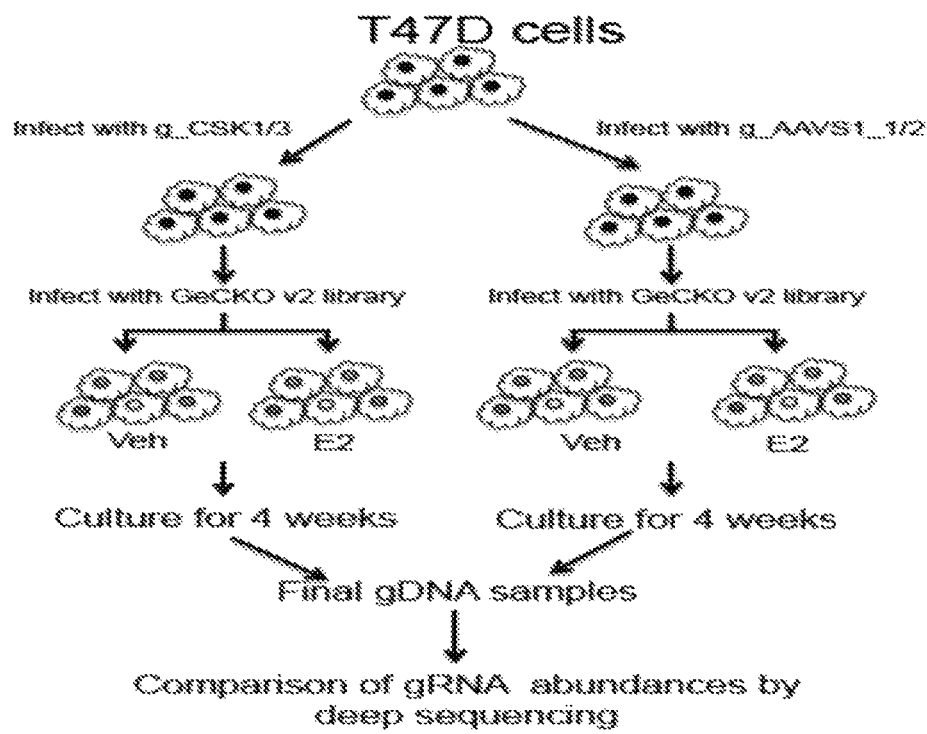
FIG. 16 includes 2 panels, identified as panels A and B, which show a secondary genome-wide screen of CSK null cells. The screening strategy (Panel A). The normalized counts of CSK-targeting gRNAs in control and CSK null cells (Panel B). The 6 CSK-targeting gRNA ids in the GeCKO2 library are shown in the legend.
Figure 16:
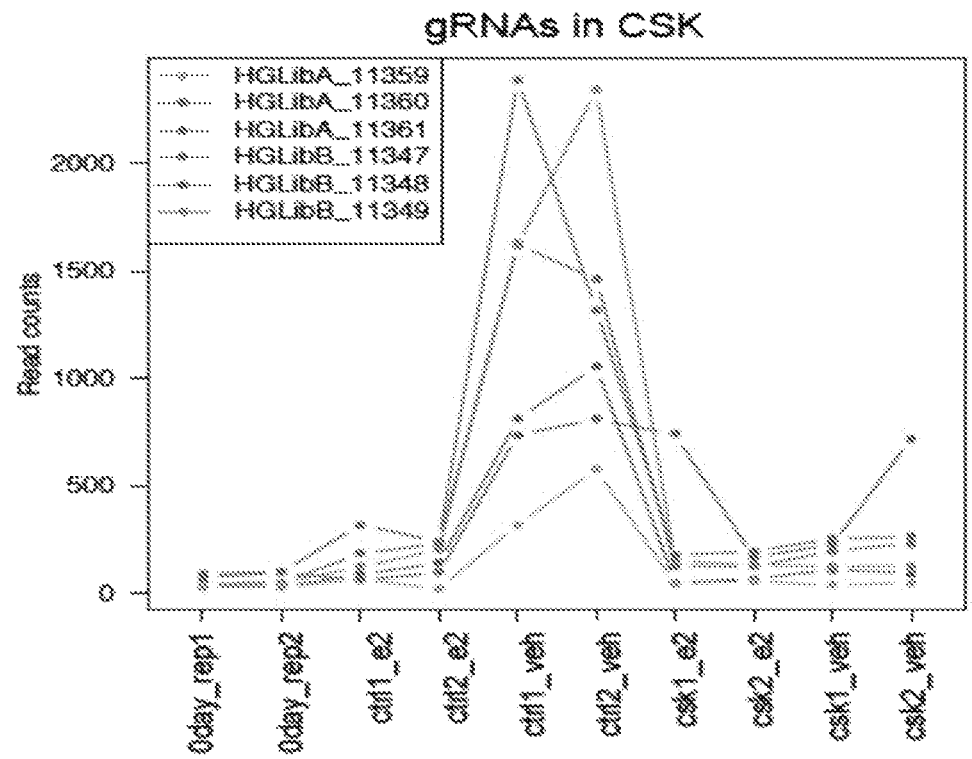
Figure 17:
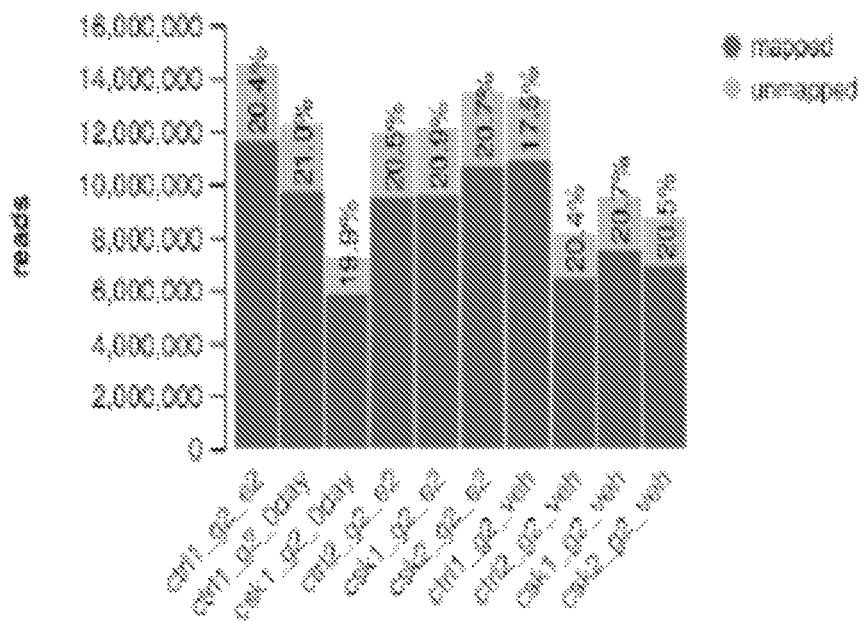
FIG. 17 includes 5 panels, identified as panels A, B, C, D, and E, which show the quality control measurements of secondary CRISPR screens. Similar to FIG. 6, the measurements include total reads and the percentage of unmapped reads (Panel A), the number of missed gRNAs (Panel B), the Gini-index of read count distribution (Panel C), the distribution of normalized reads (Panel D), as well as sample correlation and clustering results (Panel E). All measurements are generated from MAGeCK-VISPR (Li, W et al. (2015) *Genome Biol.* 16:281).
Figure 17:
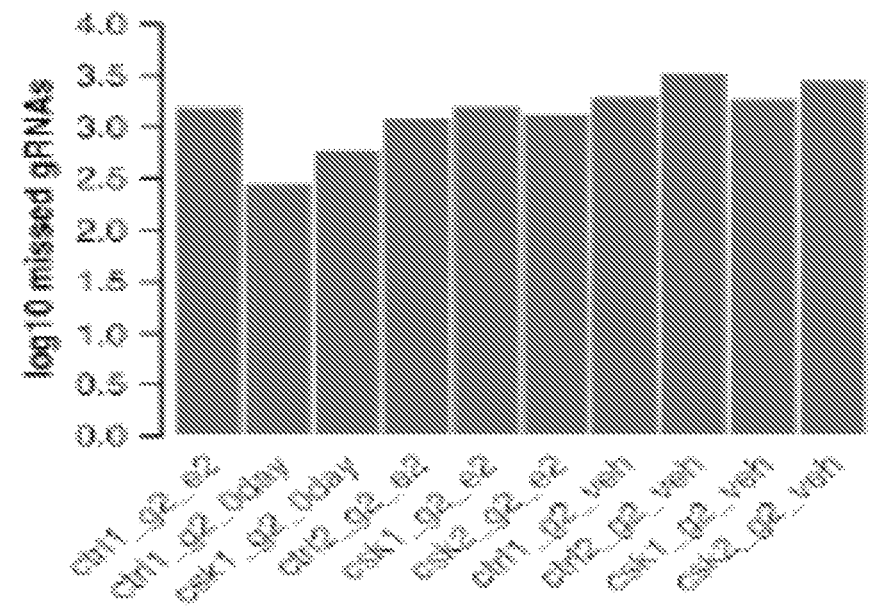
Figure 17:
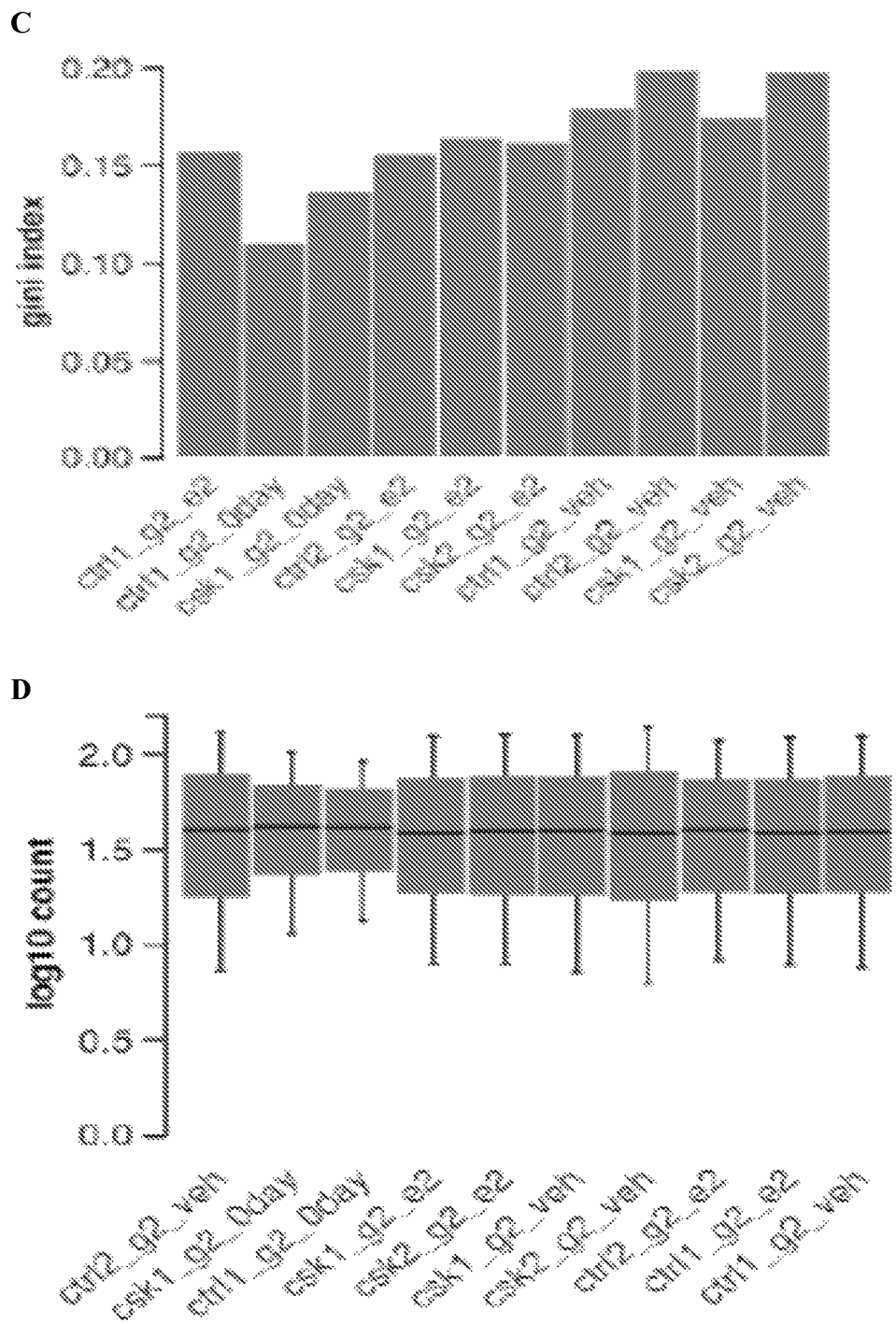
Figure 17:
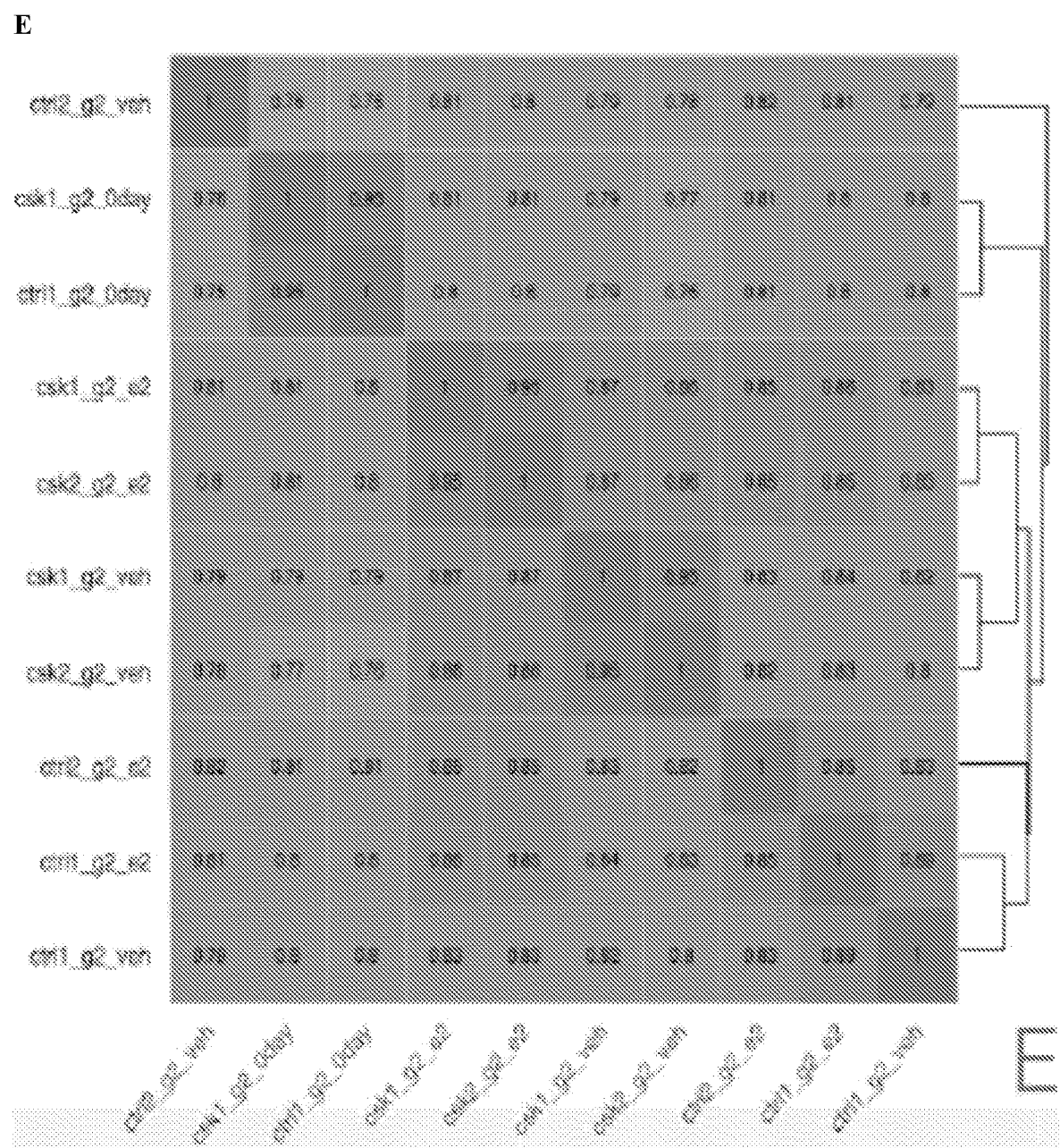

Example 5: Genome-Wide CRISPR Screen for Genes Synthetically Lethal with CSK Loss To identify the key genes that drive hormone independent growth upon CSK loss, a second round of genome-wide CRISPR screening was performed in the T47D-CSK null cells using cells infected with gRNAs targeting AAVS1 as control (FIGS. 16 and 17). Using the same approach to compare public screening datasets of non-breast cancer cell lines, 649 specific essential genes were identified in T47D-CSK null cells with statistical significance (FUR≤0.05; FIG. 18, Table 8). These genes include genes in the HER2 (ERBB2), PI3K-AKT (PIK3R1, AKT1), as well as MAPK signaling pathways (MAPK8, PAK2) that are known to be activated in endocrine resistant breast tumors (Musgrove et al. (2009) Nat. Rev. Cancer 9:631-643) (FIG. 4, Panel A). Interestingly, ER remains essential in the absence of CSK, albeit to a lesser extent compared with CSK wild-type cells ($\beta$=−0.43 and −0.28, ranking=23 and 629 in CSK wild-type and null cells, respectively). The essentiality of ER and genes in HER2/EGFR signaling pathway in CSK null cells is further supported by the up-regulated ER expression in CSK-null cells (FIG. 14), and the fact that CSK-null cells were sensitive to fulvestrant, but not tamoxifen (FIG. 3, Panels B and C).

It was next sought to identify genes that are specifically essential in CSK-null cells as these would be potential therapeutic targets in endocrine resistant breast cancer induced by the loss of CSK function. These genes should be essential in CSK-null cells (treated with vehicle) but not in CSK wild-type cells (treated with E2). Applying the same method to compare screening results between CSK wild-type and null cells, over 60 genes were discovered that are selectively required in CSK null cells (FIG. 19 and Table 9). Several top hits such as EPHB2, CRK, PAK2 and PIK3R2 are in the pathways of Src Family Kinases (SFKs) (FIG. 4, Panel A). However none of the nine SFK members could be identified as essential gene in CSK null cells (FIG. 19), indicating that paralogs of the SFKs may provide functional redundancy (Wang et al. (2015) Science 350:1096-1101).

Figure 20:
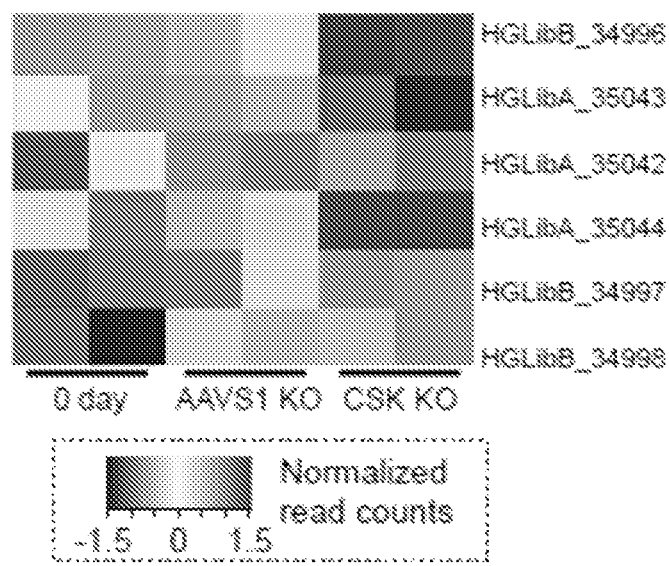
FIG. 20 includes 2 panels, identified as panels A and B, which show the normalized counts of PAK2 (Panel A) and CRK (Panel B) targeting gRNAs in 0-day, AAVS1 knockout and CSK knockout cells.
Figure 20:
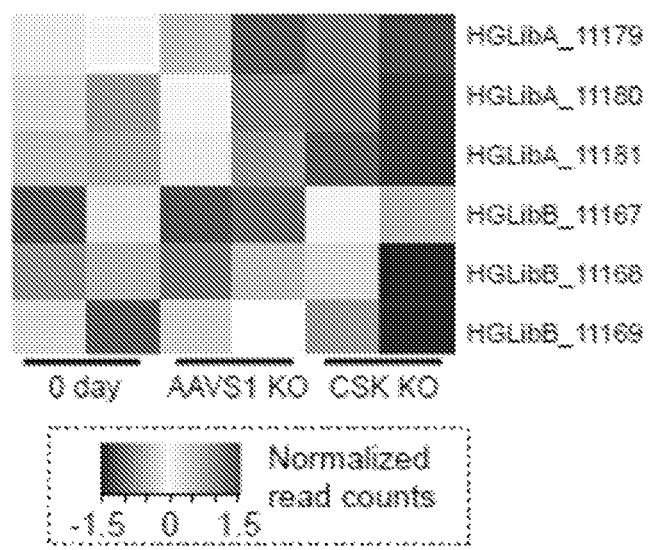

Two particularly interesting genes, PAK2 and CRK (FIG. 20), are significantly up-regulated upon CSK loss (adjusted p-value=0.0014 for PAK2, and 1.83e-13 for CRK, respectively; FIG. 14). PAK2 (p21 protein-activated kinase 2) is a serine/threonine kinase whose activity can be stimulated by small GTPases CDC42 and RAC1 (Knaus et al. (1995) Science 269:221-223) and regulated by the Src Family Kinases (SFKs) (Renkema et al. (2002) Mol. Cell. Biol. 22:6719-6725; Koh et al. (2009) J. Cell. Sci. 122:1812-1822). CRK (proto-oncogene c-crk) is a member of an adapter protein family that binds to several tyrosine-phosphorylated proteins and involved in activating SFKs (Sabe et al. (1992) Mol. Cell. Biol. 12:4706-4713). It was decided to focus first on PAK2 among the top synthetic lethal candidates of CSK because it is known to be downstream of CSK signaling and it is a potential therapeutic target with existing small molecule inhibitors. To confirm the specific requirement of PAK2 in the CSK null cells, PAK2 was knocked out in the CSK null cells and control cells using three different gRNAs targeting PAK2 (FIG. 4, Panel B). As expected, PAK2 is essential only in the CSK null cells cultured in the Veh condition, but not in the control cells in the E2 condition and the degree of essentiality is correlated with the knockout efficiency (FIG. 4, Panels B and C). In addition, the cell growth inhibition in the CSK null cells upon PAK2 loss could be rescued by the doxycycline-inducible overexpression of a gPAK2/Cas9-resistant PAK2 cDNA (FIG. 4, Panel D), confirming the essential role of PAK2 in hormone-independent cells induced by CSK loss.

To further understand how CSK loss leads to PAK2 activation, the autophosphorylation patterns of PAK2 and SFK was investigated. The autophosphorylation site (Serine141) of PAK2, an important marker of PAK2 activation (Jung et al. (2005) J. Biol. Chem. 280:40025-40031), could be distinctly detected in the CSK null cells but not in the control or the CSK-rescued cells (FIG. 4, Panel E). Importantly, this differential phosphorylation pattern of PAK2 is well correlated with the differential phosphorylation pattern of the SFKs (FIG. 4, Panel E), suggesting PAK2 and SFKs could be simultaneously activated upon CSK loss. To understand whether the activation of PAK2 is SFKs dependent, CSK null cells were treated with two SFK inhibitors Dasatinib and Saracatinib. The phosphorylation of PAK2S141 was abrogated upon the inhibitor treatment (FIG. 4, Panel F), suggesting SFKs are involved in PAK2 activation by tyrosine phosphorylation. To uncover the specific tyrosine on PAK2 that is important for PAK2 function, three Y-to-F mutations (Y130F, Y139F, Y194F) were generated of PAK2 previously implicated in PAK2 function (Renkema et al. (2002) Mol. Cell. Biol. 22:6719-6725). As PAK2 is essential in CSK-null cells, vectors were first introduced to allow inducible overexpression of WT PAK2 and the PAK2 mutants in CSK null cells. The endogenous PAK2 was then deleted using a specific gRNA and the cell viability was assayed in the presence or absence of the inducible PAK2 alleles. While the Y139F and Y194F mutants could rescue PAK2 function to similar levels as wild-type PAK2, the Y130F mutant failed to rescue PAK2 function (FIG. 4, Panel D), indicating the critical role of Y130 in SFK-mediated phosphorylation and activation of PAK2.

Example 6: Clinical Relevance and Potential Therapeutic Strategies

Figure 5:
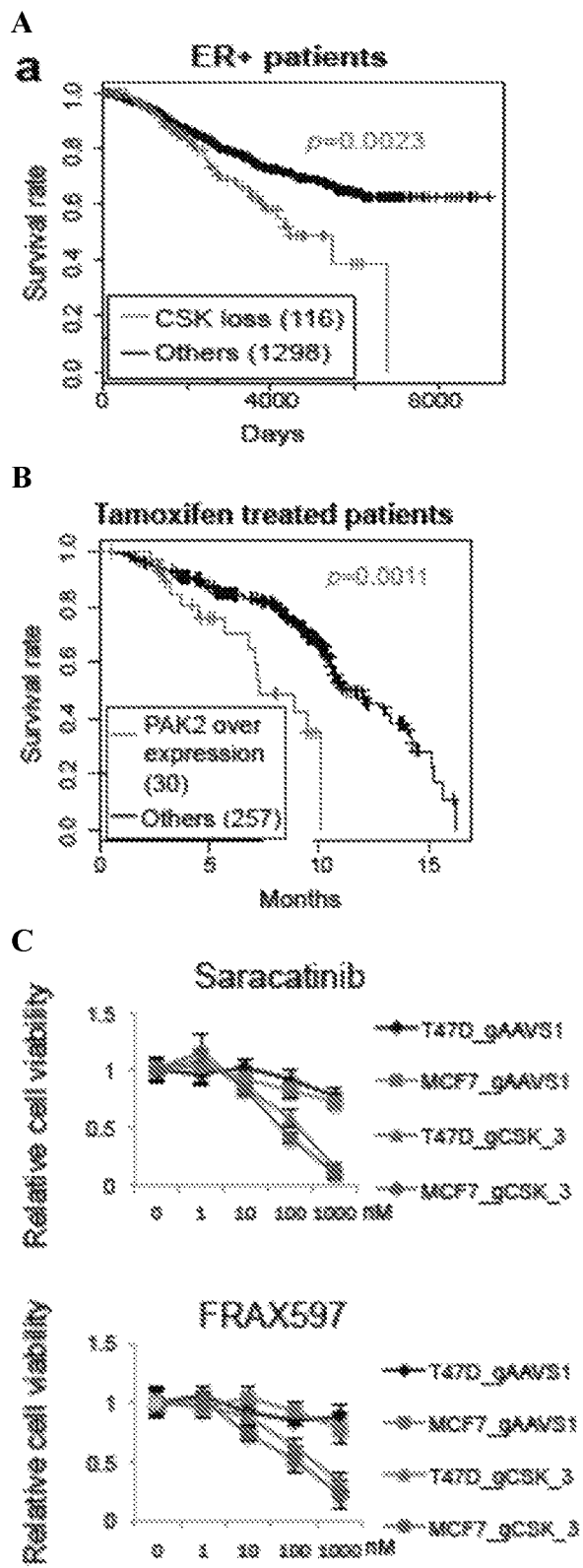
FIG. 5 includes 4 panels, identified as panels A, B, C, and D, which show the clinical relevance of CSK and PAK2. CSK loss corresponds to worse clinical outcome in META-BRIC breast cancer patients (Panel A). The p-value is calculated using the log-rank test. The p-value is calculated using the log-rank test. PAK2 over-expression corresponds to worse clinical outcome in breast cancer patients treated with tamoxifen (Panel B). Relative cell viability of control (AAVS1), CSK-null cells after treatment with a SFK inhibitor (Saracatinib) and a PAK2 inhibitor (FRAX597) for 5 days are shown (mean±SD, for n=3) (Panel C). The control cells were cultured in hormone-depleted medium plus E2 (10 nM) and the CSK-null cells were cultured in hormone-depleted medium plus vehicle. Proposed mechanism of endocrine Resistance driven by CSK loss and synthetic lethal vulnerabilities with SFK and PAK2 genes for ER+ breast cancer (Panel D).
Figure 5:
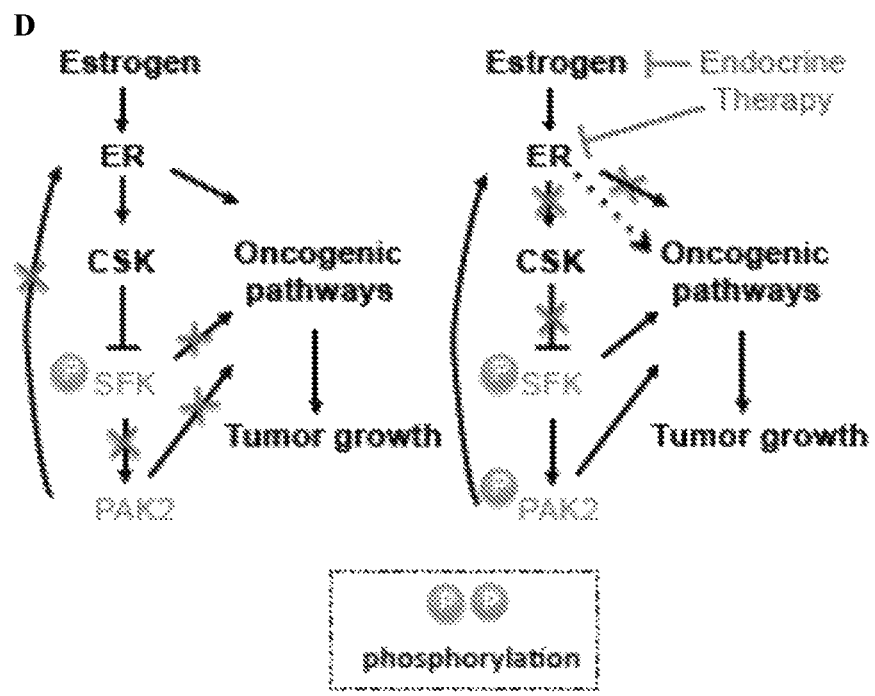
Figure 21:
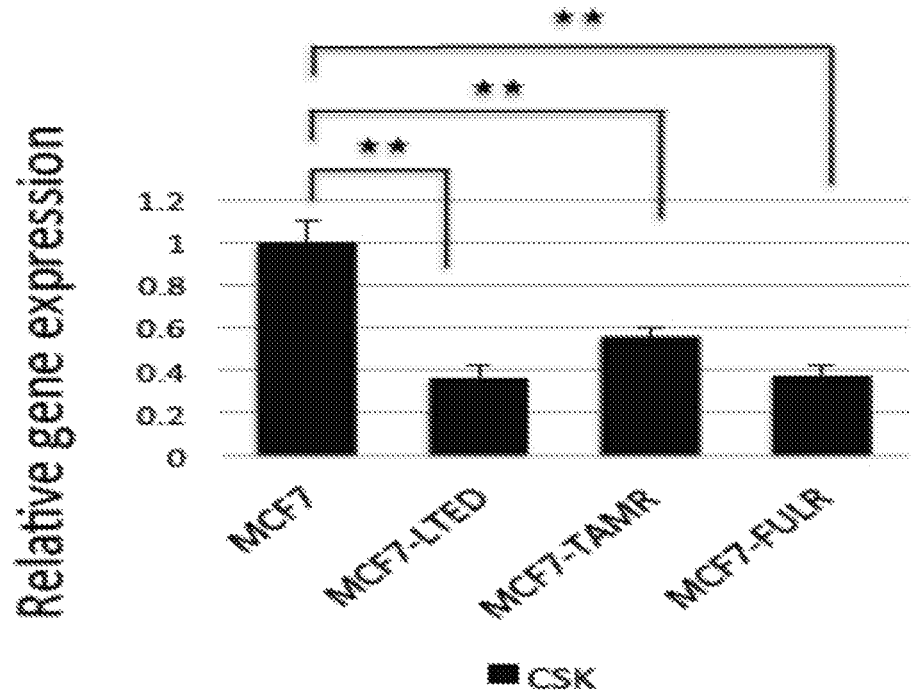
FIG. 21 includes 3 panels, identified as panels A, B, and C, which show expression of CSK in TAMR, FULR and LTED cells. The relative expressions of CSK in T47D and MCF7, as well as the long-term estrogen deprivation (LTED) cells and tamoxifen/fulvestrant-resistant (TAMR/FULR) cells (Panels A and B). The relative gene expression was measured by qRT-PCR after normalizing to the amount of GAPDH signal (mean±SD, for n=3) ** p<0.01, student's t test. The protein expression of CSK in wild-type T47D and MCF7, as well as LTED T47D and two LTED MCF7 cells (2A-MCF7 and 5C-MCF7) (Panel C). GAPDH was used as a loading control.
Figure 21:
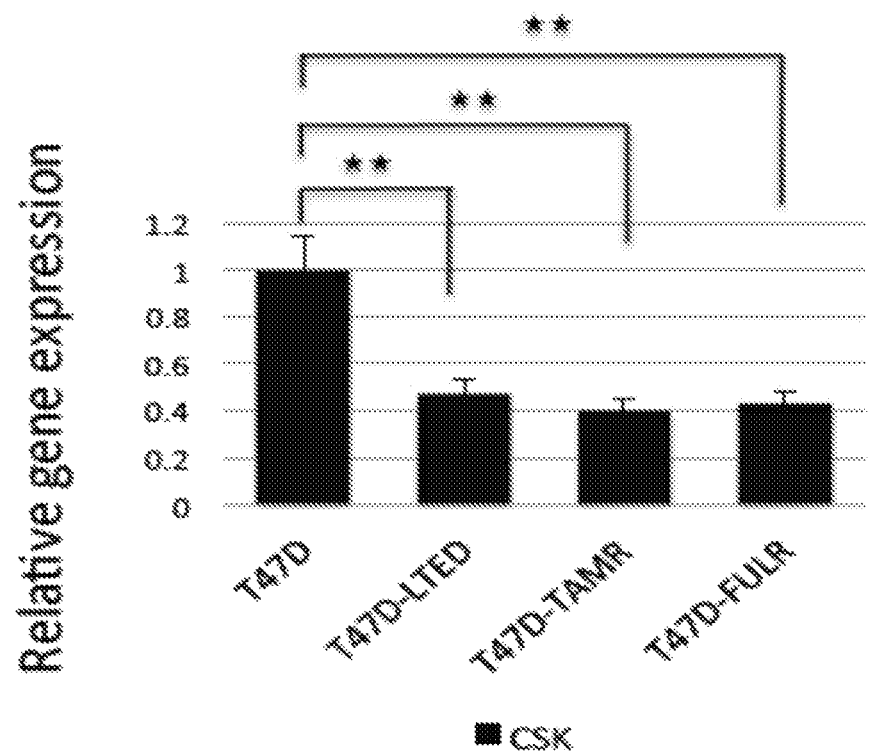
Figure 21:
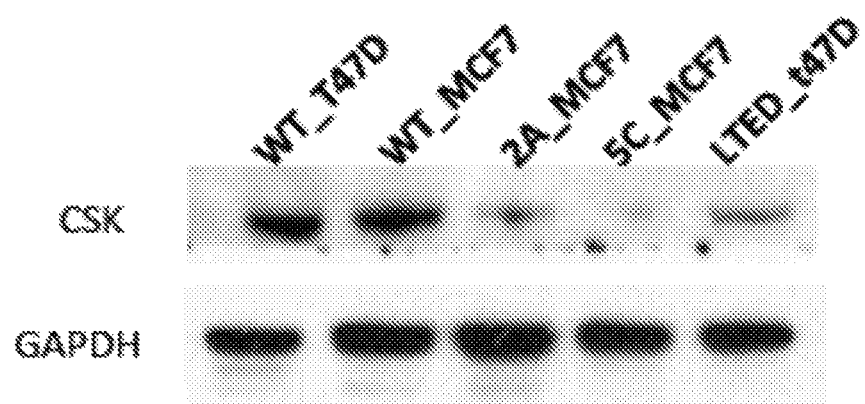
Figure 22:
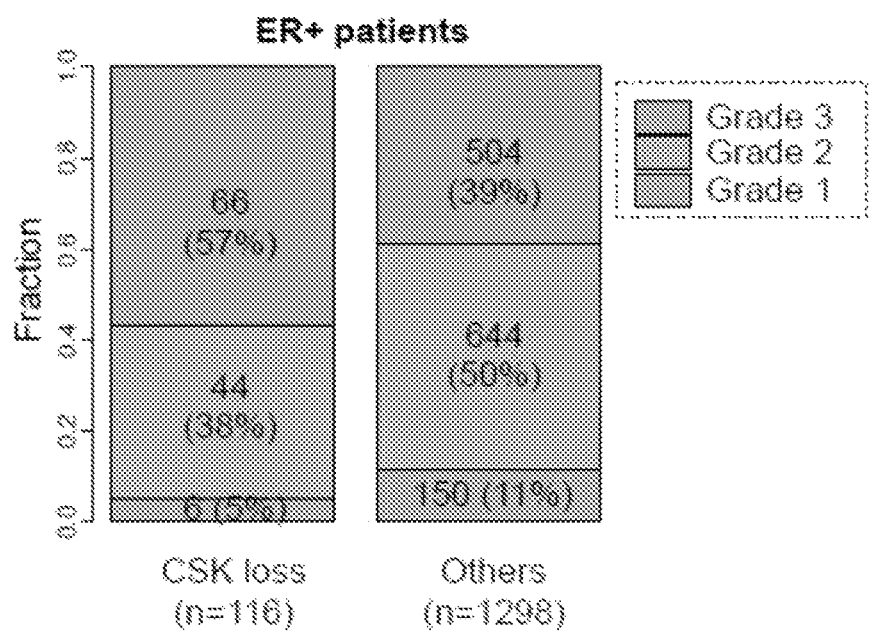
FIG. 22 includes 3 panels, identified as panels A, B, and C, which show the clinical implications of CSK in breast cancer. CSK loss corresponds to higher grade tumors in the METABRIC dataset (Panel A). Lower expression of CSK indicates worse clinical outcome in two expression datasets of tamoxifen treated breast cancer patients (Panels B and C). Expression data is extracted and processed from NCBI Gene Expression Omnibus (GEO) under the accession number GSE17705 (b) and GSE1379 (c).
Figure 22:
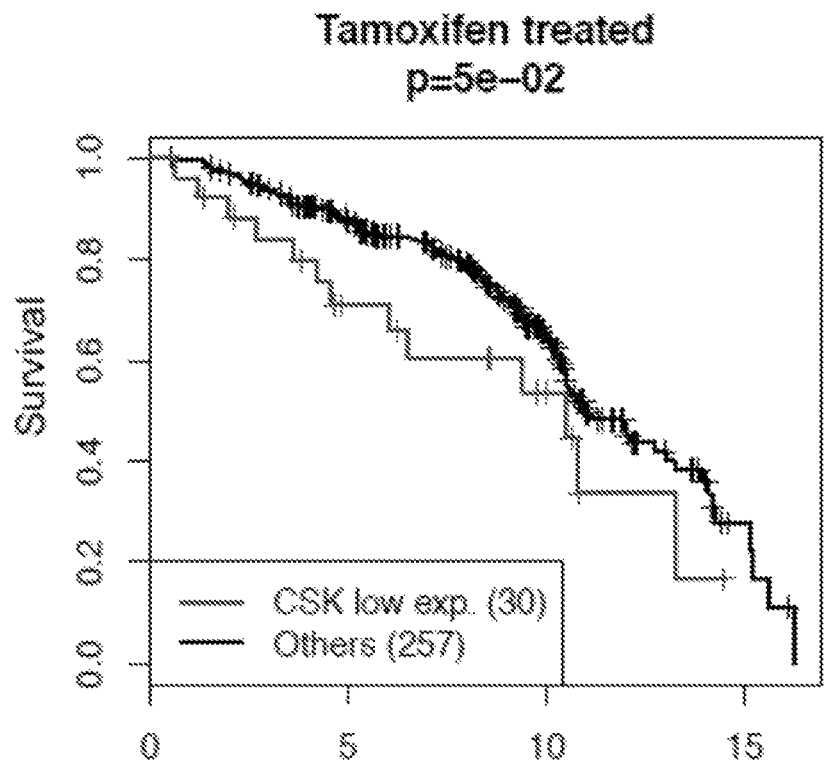
Figure 22:
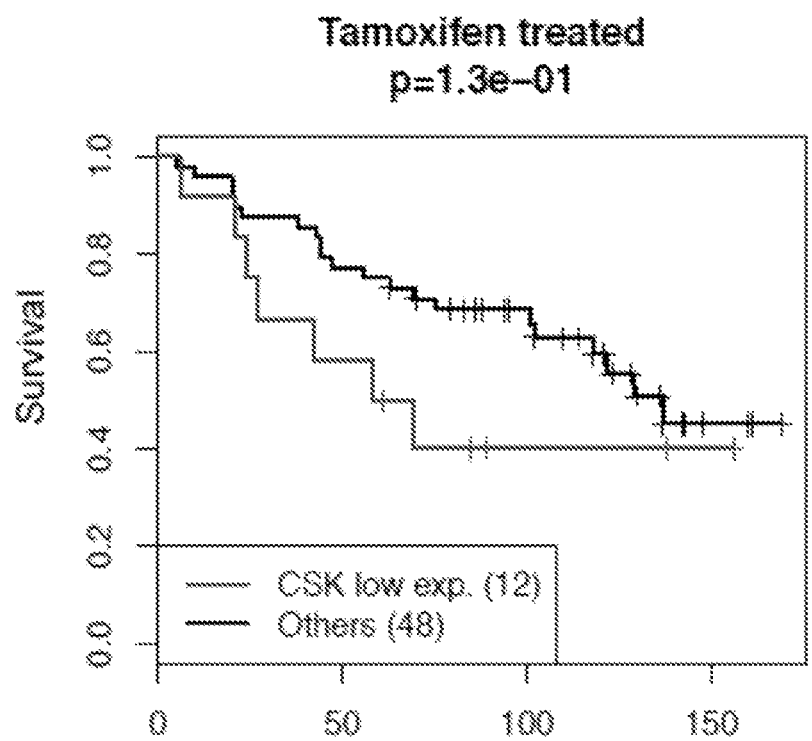
Figure 23:
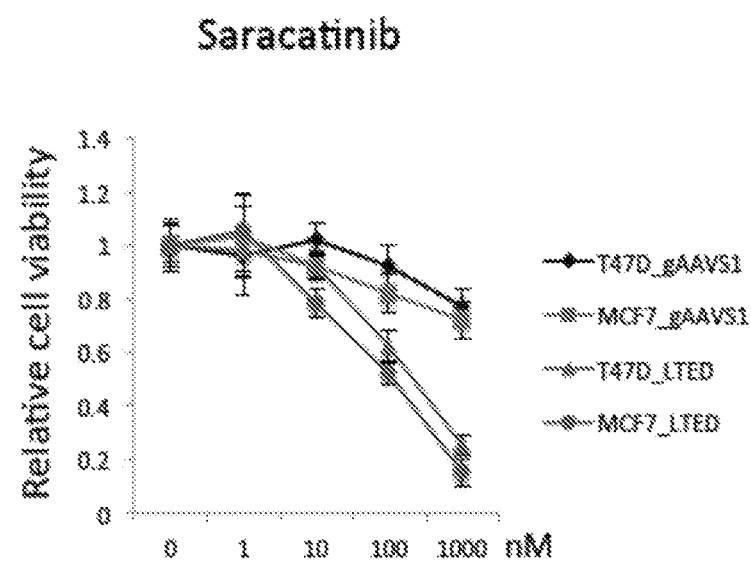
FIG. 23 includes 2 panels, identified as panels A and B, which show treatment of SFK and PAK2 inhibitors. Relative viability of control (AAVS1) and LTED cells treated with Saracatinib (SFK inhibitor) (Panel A). Relative viability of control (AAVS1) and LTED cells after treatment with FRAX597 (PAK2 inhibitor) (Panel B). Relative viability of cells after treatment with indicated compound concentrations for 5 days are shown (mean±SD, for n=3). The control cells were cultured in hormone-depleted medium plus E2 (10 nM) and the CSK-null cells were cultured in hormone-depleted medium plus vehicle.
Figure 23:
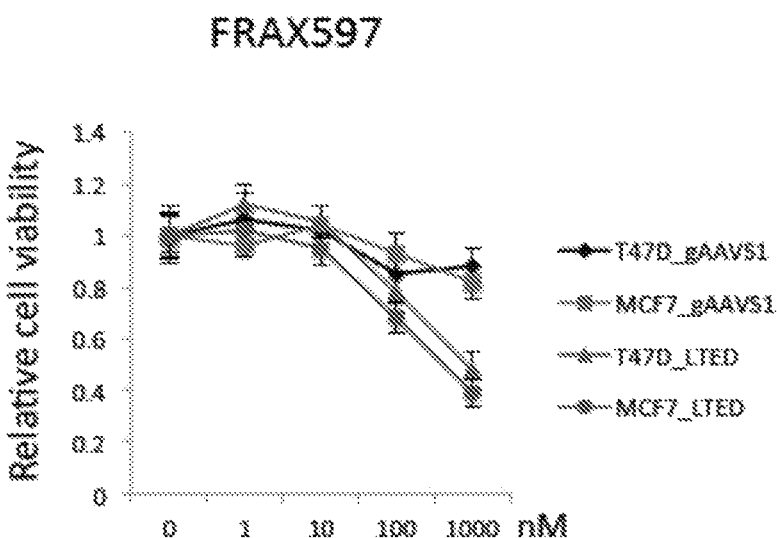

In order to extend the potential relevance of CSK loss as a mechanism of endocrine resistance, CSK expression was examined in other models including long-term estradiol deprivation (LTED) cells derived from MCF7 or T47D, as well as tamoxifen- or fulvestrant-resistant cell MCF7 or T47D cells (FIG. 21). CSK is significantly down-regulated in all of these models suggesting that down-regulation of CSK may be a general mechanism of acquired endocrine resistance. To explore the clinical importance of CSK in ER+ breast cancers, we analyzed the expression and copy number variation (CNV) profiles of CSK from public datasets (FIG. 22). In the METABRIC dataset (Curtis et al. (2012) Nature 486:346-352), CSK loss is associated with high-grade ER+ tumors (FIG. 22, Panel A) and worse survival rates in ER+ breast cancer patients (FIG. 5, Panel A). In two studies including patients treated with over 5 years of tamoxifen treatment (Symmans et al. (2010) Journal of clinical oncology 28:4111-4119; Ma et al. (2004) Cancer Cell 5:607-616), lower CSK expression corresponds to shortened survival rate (FIG. 22, Panels B and C), and the higher expression of PAK2 is significantly associated with worse relapse-free survival (FIG. 5, Panel B). To test PAK2 as a potential therapeutic target for endocrine resistant breast cancer, CSK null cells were treated as well as T47D and MCF7 derived LTED cells with a PAK2 inhibitor (FRAX597) and an SFK inhibitor (Saracatinib, FIG. 5, Panel C, FIG. 23). All of the CSK null cells are sensitive to either of the two inhibitors in the estrogen-depleted medium, indicating that a combined treatment of an aromatase inhibitor with PAK2 or SFK inhibitors could be useful for treating endocrine resistant tumors.

In conclusion, the mechanism and potential therapeutic targets of endocrine resistance were investigated in breast cancer using genome-wide CRISPR screens (FIG. 5, Panel D). CSK was found as an estrogen-stimulated tumor suppressor whose loss drives hormone-independent cell growth. From a second round of genome-wide CRISPR screening, synthetic lethal interactions were uncovered between CSK and PAK2 in endocrine resistant breast cancer cells. In the presence of estrogen, ER activates CSK whose expression represses SFK and PAK2 activity. These findings suggest a feedback loop by which endocrine therapies that inhibit ER activity repress CSK expression leading to activation of Src kinases and PAK2. Deletion of CSK disrupts this feedback loop, allowing the activation of SFK and PAK2 independent of ER regulation. Activation of SFK and PAK2 turns on oncogenic signaling pathways, promoting estrogen independent growth and an invasive phenotype. The CRISPR screen results, combined with clinical observation of CSK and PAK2 expression on patient survival as well as cell growth upon inhibitor treatments, support PAK2 as a potential therapeutic target for treating endocrine resistance in ER+ breast cancer patients. In addition, the demonstration of the use of two rounds of genome-wide CRISPR screens to systematically identify synthetic lethal interactions is an approach that can be applied to discover novel therapeutic strategies in other settings.

Example 7: Further Validation of CSK and PAK2 as Potential Therapeutic Targets

Figure 24:
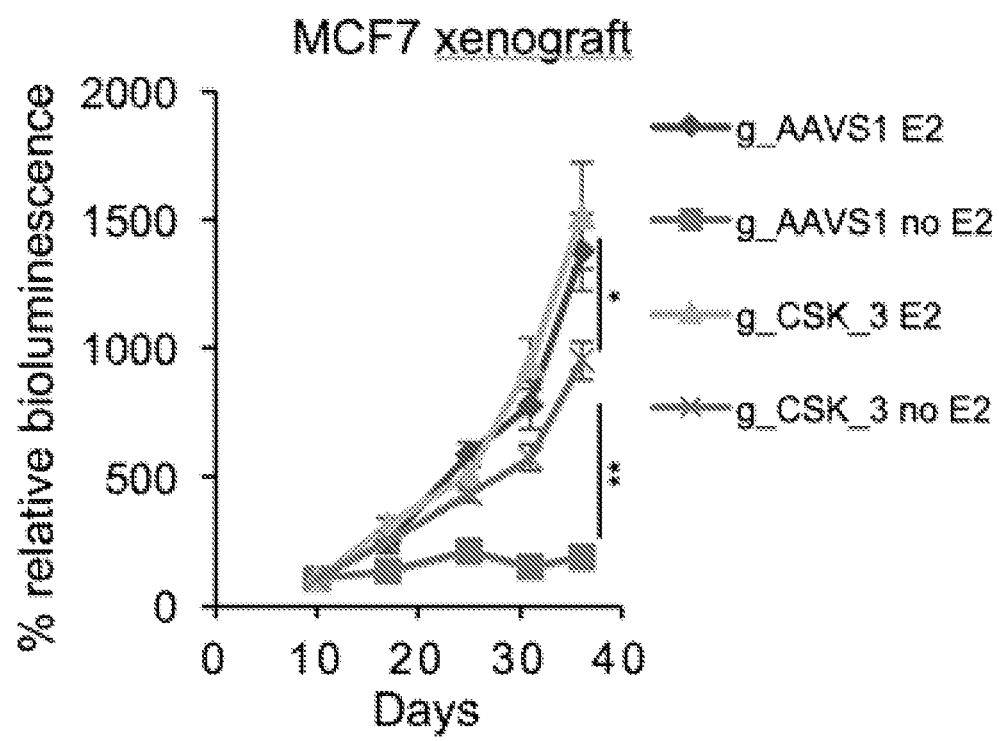
FIG. 24 shows the estrogen-independent growth of MCF7 xenografts. MCF7 cells harboring either gAAVS1 or gCSK were injected to the ovariectomized nude mice in the presence of estrogen. Mice were assigned randomly (day 7), in groups of eight, to continued estrogen supplementation (E2, 0.1 mg/kg/week) or estrogen withdrawal (−E2). Luminescence values were plotted as an average of % of the first measurement (% relative bioluminescence) for each mouse in each respective group. The measurements were done in intact male mice at days 10, 17, 25, 31, and 37 after tumor cell injection, *P<0.05, **P<0.005, two-tailed student's t-test.

Further experiments were performed to validate the role of CSK and RAK2 in cancer. For example, similarly to procedures described previously (e.g., for FIG. 2), MCF7 xenografts were prepared after infection with AAVS1_gRNA (control) or CSK_gRNA, further treated with or without estrogen (E2). As the result, CSK loss led to endocrine-independent tumor growth in mouse (FIG. 24).

Figure 25:
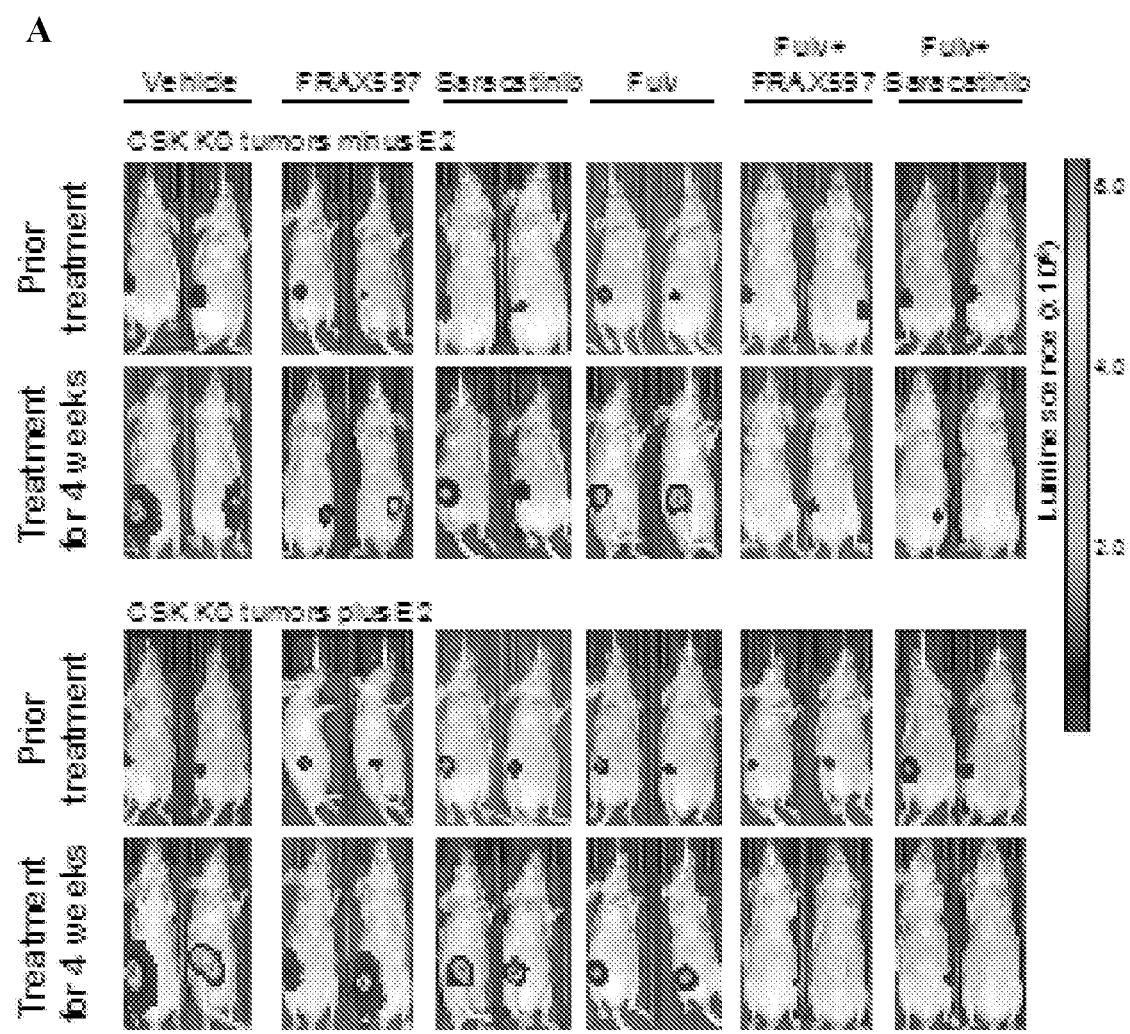
FIG. 25 includes 2 panels, identified as panels A and B, which show the results of treating CSK-null tumors with PAK2 and/or SFK inhibitors. Panel A includes representative images showing bioluminescent signals in female athymic ovariectomized nude mice plus/minus estrogen (0.1 mg/kg/week) bearing MCF7 CSK null tumors, which treated with vehicle (10% (PEG400:Tween-80:PVP-K30, 90:5:5), 15% Vitamin E-TPGS, 75% of hydroxypropylcellulose (0.5%) in 50 mM citrate buffer (pH 3.0), FRAX597 (60 mg/kg/day), saracatinib (40 mg/kg/day), fulvestrant (5 mg/week) or variable combinations for 4 weeks. Panel B shows the effects of treatments on the CSK null xenografts. Mice with CSK null tumors were treated with the single or combination treatment of vehicle, saracatinib, FRAX597, and fulvestrant for 4 weeks. Luminescence values were plotted as an average of % of the first measurement (% relative bioluminescence) for each mouse in each respective group (n=8). P-values were calculated by student's t-test.
Figure 25:
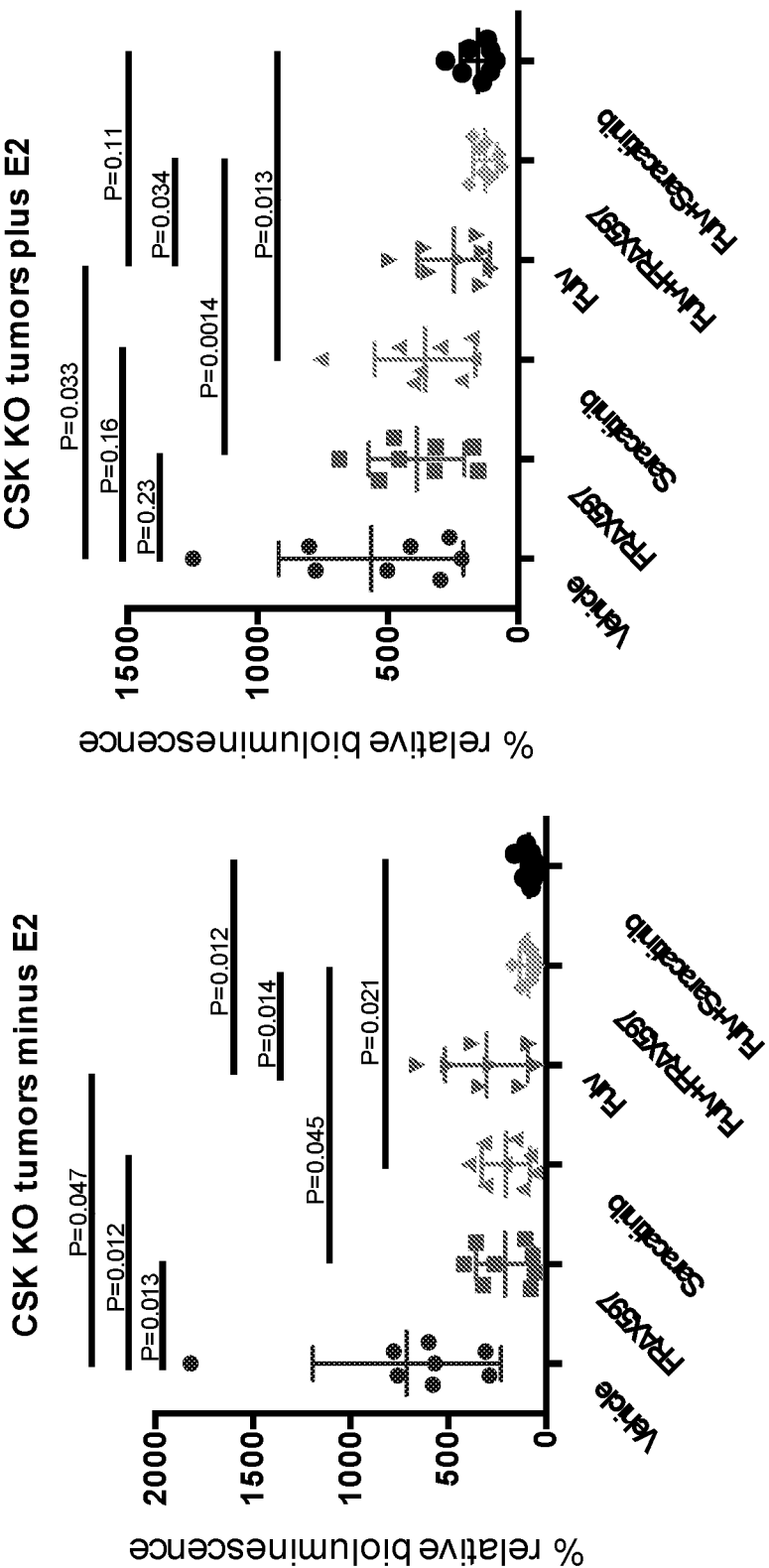

For testing PAK2 and SFK as potential therapeutic targets in endocrine resistant breast cancer, the CSK-null tumors in ovariectomized mice were treated with FRAX597 or saracatinib. As the result, the tumors were more sensitive to both inhibitors in the absence of estrogen than in the presence of estrogen (FIG. 25A). While fulvestrant alone inhibited the growth of CSK null tumors to some extent, the combination of fulvestrant with either the PAK2 or SFK inhibitor substantially blocked the growth of CSK null tumors with or without E2 (FIG. 25B).

Figure 26:
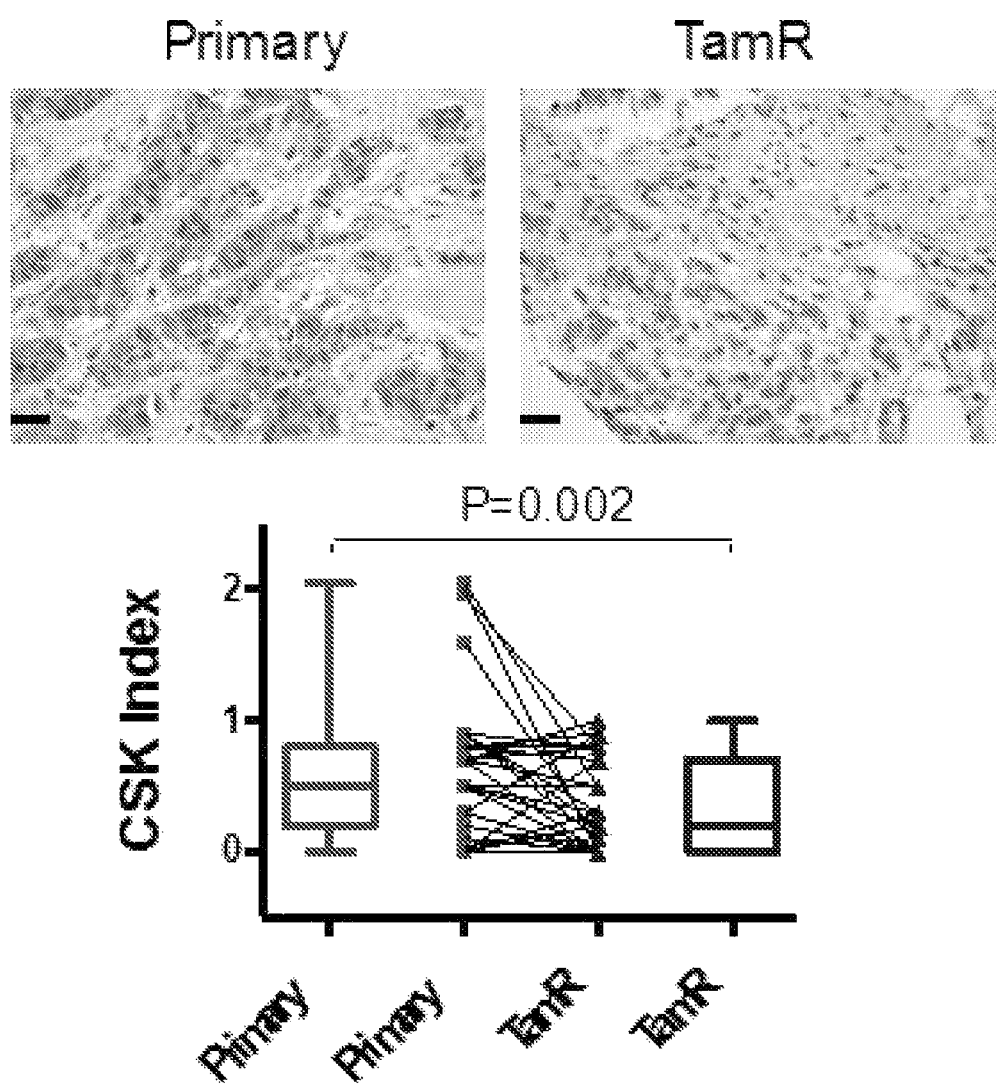
FIG. 26 illustrates images of CSK staining (immunohistochemistry) in matched primary and tamoxifen resistant (Tamer) ER+ breast tumors (scale bar 100 um). Quantification of CSK staining in 47 matched pairs of primary and tamoxifen resistant tumor samples are shown (two-tailed paired student's t-test).

In order to further investigate the potential relevance of CSK loss as a mechanism of endocrine resistance, CSK expression was examined in 47 matched pairs of primary and tamoxifen resistant tumor samples by immunohistochemistry. It was found that CSK expression in the tumor cells was significantly down-regulated in 63.8% ($30/47$) of tamoxifen resistant tumors (FIG. 26). The tissue sections were reviewed and scored in a blinded manner for staining intensity (0-3) and proportion (0-100%) of CSK expression in tumor cells by an expert breast cancer pathologist.

Figure 27:
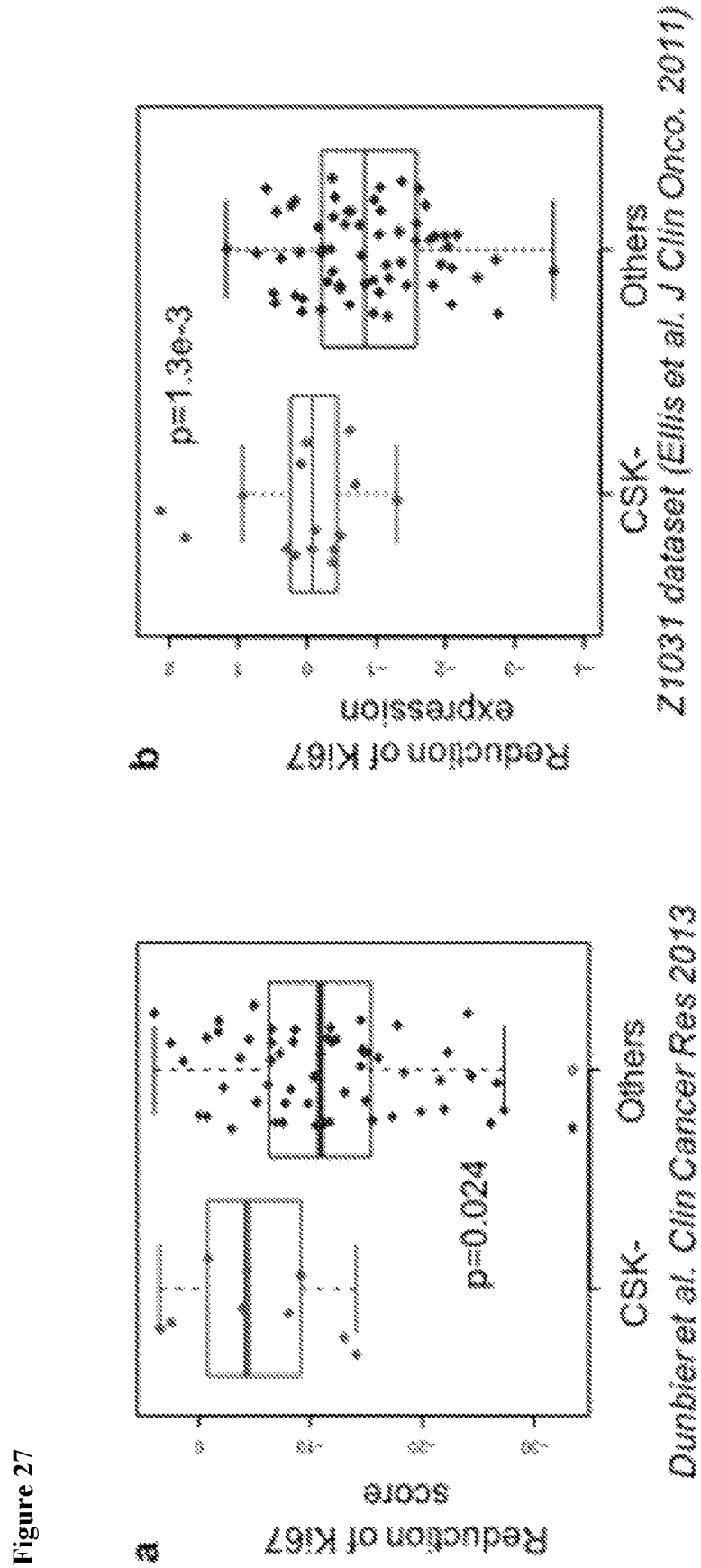
FIG. 27 includes 2 panels, identified as panels A and B, which show clinical implications of CSK and PAK2 in breast cancer patient survival. CSK gene signatures predict patient response to endocrine treatments in two endocrine treatment clinical trials that have matched expression measurements before/after treatment (Dunbie et al. (2013) *Clin. Cancer Res.* 19:2775-2786; Ellis et al. (2011) *J. Clin. Oncol.* 29:2342-2349). CSK-patients (with reduced expression of CSK signature genes after treatment) have a less reduction of Ki67 gene expression, an indication of less efficacy in endocrine treatment. The p value is calculated using Wilcox rank-sum test.

The gene expression profiles from two pre-surgical endocrine-therapy clinical trials were analyzed. Inhibition of estrogen-mediated ER signaling with an aromatase inhibitor led to decreased expression of CSK signature genes (affecting ~15-20% patients). In addition, tumors with decreased CSK expression had less reduction in Ki67 expression, the only validated biomarker of outcome in ER+ breast cancer pre-surgical trials (FIG. 27). These clinical findings support the conclusion that inhibition of CSK expression limits the efficacy of current endocrine therapy.

Figure 28:
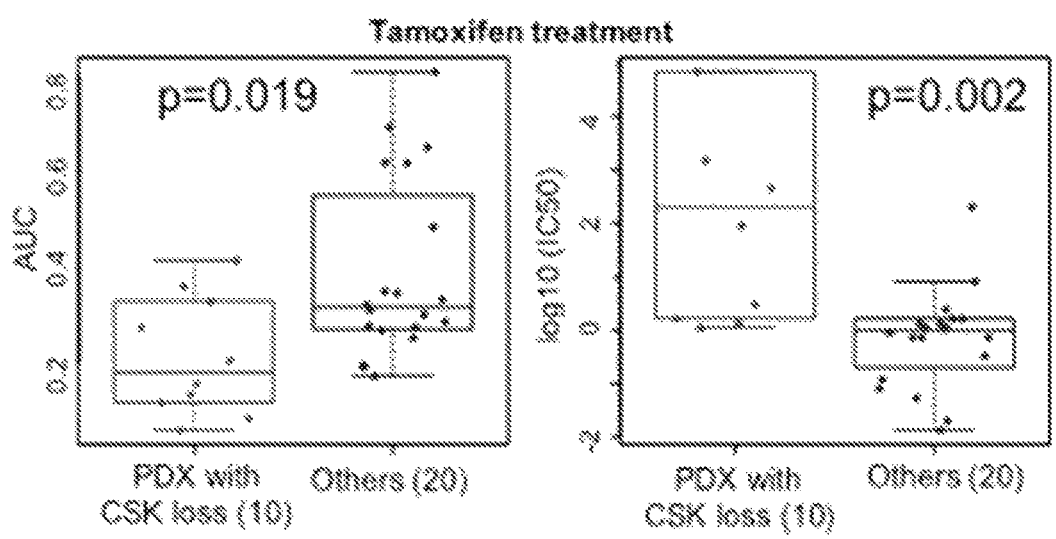
FIG. 28 includes 2 panels, identified as panels A and B, which show that CSK loss indicates worse treatment response in patient-derived xenograft (PDX) breast cancer models. The CSK copy number and drug response measurements from PDX models are downloaded from the BCaPE database 9 (at the World Wide Web site of caldaslab.cruk.cam.ac.uk/bcape). For tamoxifen treated samples, PDX models with CSK CNV loss had lower AUC values (indicating less response to drug treatments) and higher IC50. p-value is calculated using Wilcox rank-sum test.
Figure 28:
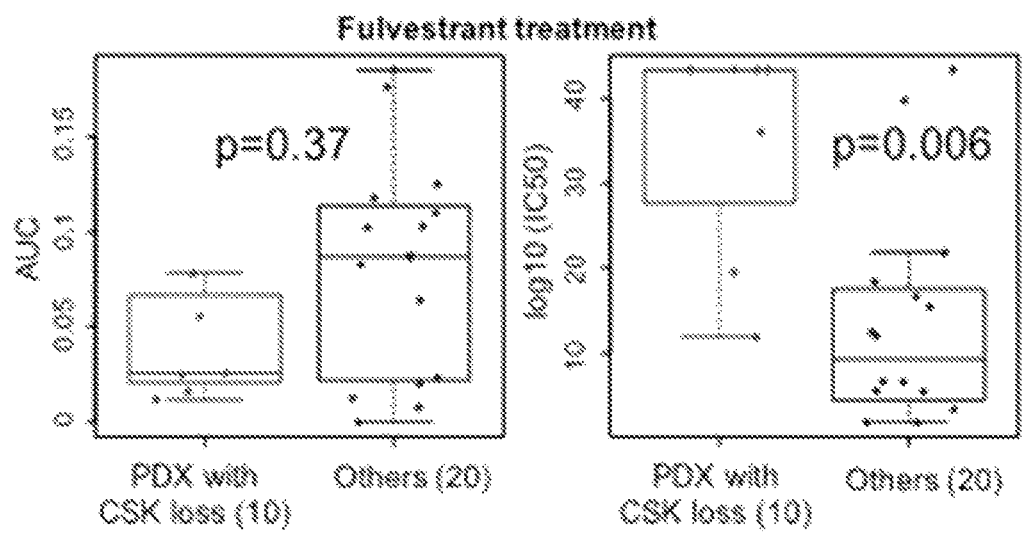

Data from a biobank of breast cancer pharmacogenomics studies (available at the World Wide Web site of caldaslab.cruk.cam.ac.uk/bcape) were analyzed. One-third of breast cancer PDX models harbor copy number loss of the CSK gene. Compared with samples without CSK loss, these PDX models are associated with resistance to tamoxifen or fulvestrant (FIG. 28).

Figure 29:
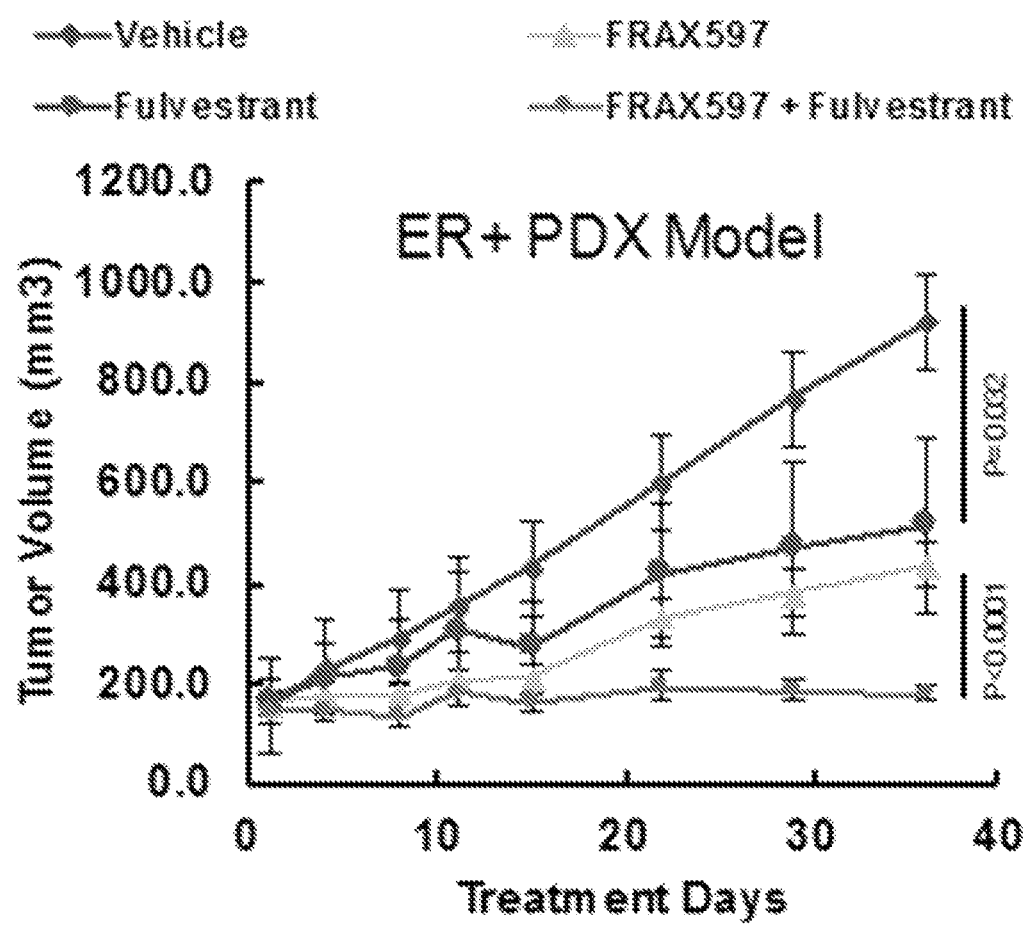
FIG. 29 compares single or combination treatments of vehicle, FRAX597 and fulvestrant in TM00386 PDX (Jackson Labs) tumors for 35 days in each respective group (n=8). P-values are indicated from two-tailed unpaired t-test. Data are represented as means±SD.

In order to support the finding that PAK2 loss is synthetically lethal with CSK loss and to demonstrate that PAK2 is therapeutically targetable to increase the efficacy of endocrine therapy, effects of treatments with a PAK2 inhibitor alone (FRAX597) or in combination with fulvestrant were compared using a commercially available ER+ PDX model (TM00386, available at the Jackson Laboratory World Wide Web site of tumor.informatics.jax.org/mtbwi/pdxDetails.do?modelID=TM00386). This model was confirmed at Jackson Lab on mice grown in the absence of supplemental estrogen. As a result, treatments with PRAX597 or fulvestrant alone only partially reduced growth of PDX, while the combination treatment showed strong synergy and completely inhibited tumor growth (FIG. 29).

Figure 30:
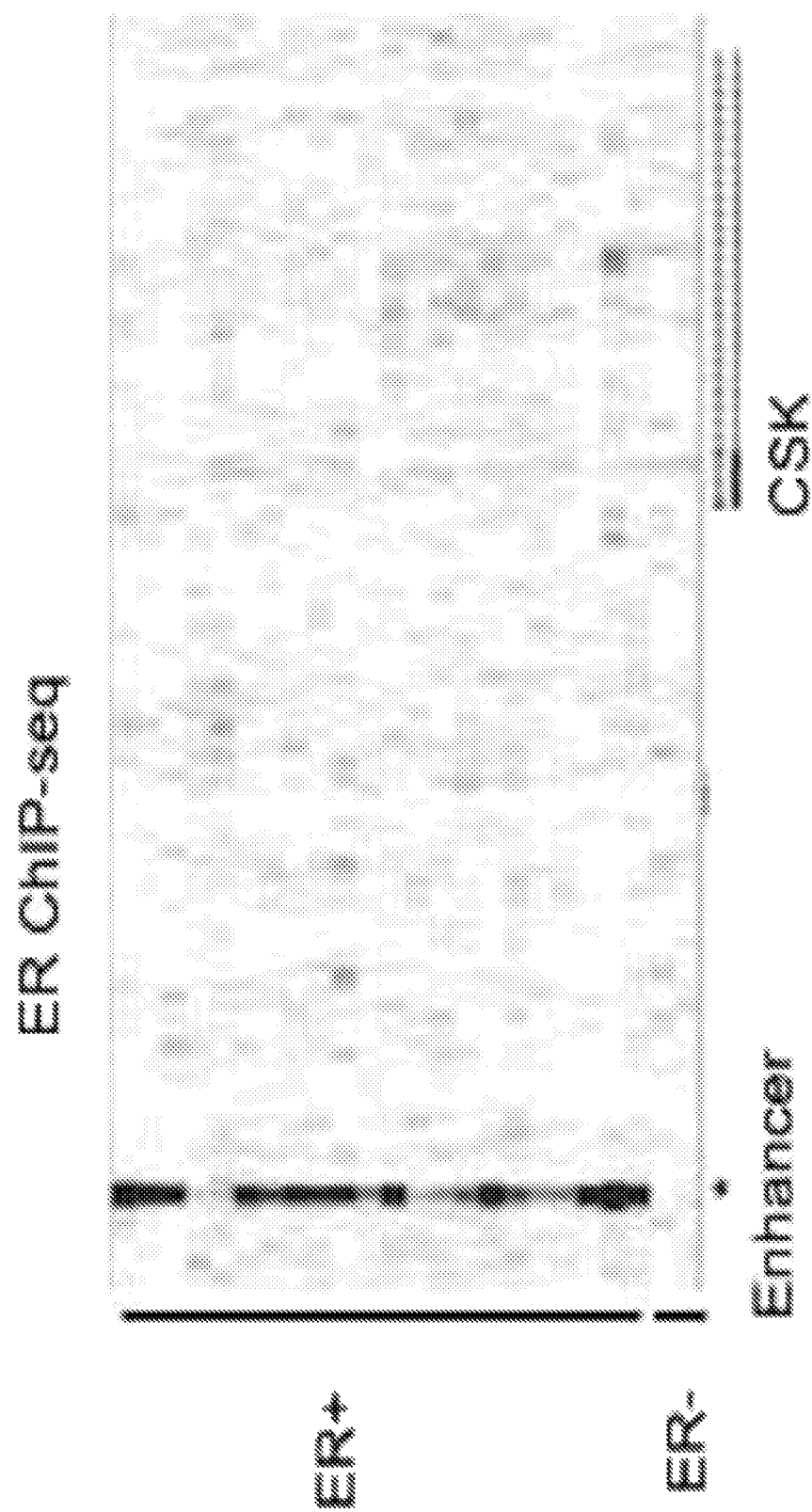
FIG. 30 shows that ER binds to the enhancer of CSK in 86% (19/22) ER+ breast cancer patients in a public ER ChIP-seq dataset.

In addition, a summary of a public dataset of chromatin immunoprecipitation followed by high-throughput sequencing (ChIP-seq) (Ross-Innes et al. (2012) *Nature* 481:389-393) shows that more than 86% of ER+ breast cancer patients have strong ER binding signals at the CSK enhancer (FIG. 30).

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the world wide web and/or the National Center for Biotechnology Information (NCBI) on the world wide web.

EQUIVALENTS

Those skilled in the art will recognize, or be able to ascertain using no more than routine experimentation, many equivalents to the specific embodiments of the present invention described herein. Such equivalents are intended to be encompassed by the following claims.

TABLE 3

| Gene | T47D_E2.beta | MCF7_E2.beta | DLD_ETOH.beta | HCT116_2_T18.beta | GBM_T21.beta |
|---|---|---|---|---|---|
| GATA3 | −1.4592 | −0.78496 | 0.23429 | 0.17492 | −0.077213 |
| FOXA1 | −0.72736 | −1.0071 | 0.33143 | 0.38481 | −0.01251 |
| SRGAP3 | −0.52205 | −0.39657 | 0.53019 | 0.46896 | 0.23863 |
| SPDEF | −0.65395 | −0.68409 | 0.22775 | 0.59734 | −0.17667 |
| TRPS1 | −0.97825 | −0.5997 | 0.30134 | −0.1543 | −0.28326 |
| STX4 | −0.67591 | −0.72942 | 0.021432 | 0.17558 | 0.41732 |
| KIAA0195 | −0.57627 | −0.82617 | 0.22456 | 0.2395 | −0.081647 |
| ARL8A | −0.54724 | −0.3886 | −0.040789 | −0.052044 | 0.03683 |
| TFAP2C | −0.67194 | −0.62849 | −0.21021 | 0.50907 | 0.11649 |
| LOXHD1 | −0.3286 | −0.3413 | 0.41469 | 0.11514 | 0.05544 |
| DUT | −0.74233 | −0.95498 | −0.36197 | −0.54032 | −0.49103 |
| TLCD1 | −0.80797 | −0.78922 | −0.19331 | −0.12903 | −0.83405 |
| WDR63 | −0.42156 | −0.28499 | −0.078315 | 0.039903 | −0.063336 |
| CACNG1 | −0.24407 | −0.3567 | 0.20662 | 0.012546 | 0.0093372 |
| GRHL2 | −1.0311 | −0.43799 | 0.11165 | 0.26511 | −0.088739 |
| TBX4 | −0.26529 | −0.41002 | 0.34175 | 0.28489 | 0.09839 |
| PHF12 | −0.67843 | −0.58709 | −0.20648 | −0.016504 | −0.62818 |
| NLRP9 | −0.39283 | −0.24501 | 0.0077705 | 0.082469 | 0.025787 |
| LPCAT3 | −0.39088 | −0.44133 | 0.30134 | 0.090095 | 0.12262 |
| GUCA1B | −0.46819 | −0.30706 | 0.3382 | 0.27314 | 0.53243 |
| SALL2 | −0.31419 | −0.30972 | 0.18333 | 0.17547 | −0.10326 |
| RFX5 | −0.46836 | −0.31901 | 0.14343 | 0.080641 | 0.030738 |
| ESR1 | −0.92751 | −0.33488 | 0.12137 | −0.11821 | 0.2139 |
| KCNRG | −0.31592 | −0.53234 | 0.17133 | −0.25962 | −0.056156 |
| NDUFS8 | −0.59498 | −0.64708 | −0.28806 | −0.51714 | −0.27945 |
| SPNS1 | −0.30497 | −0.33147 | −0.0789 | 0.047686 | 0.063614 |
| TMEM64 | −0.34073 | −0.35605 | −0.025535 | −0.0054198 | −0.21315 |
| PREXI | −0.31858 | −0.44165 | 0.13394 | 0.087427 | −0.072716 |
| FLG2 | −0.31762 | −0.49767 | 0.19631 | 0.079124 | 0.30829 |
| SFT2D3 | −0.33745 | −0.46397 | 0.18826 | 0.36945 | −0.38953 |
| DDAH2 | −0.38329 | −0.25342 | 0.33391 | −0.13483 | 0.12788 |
| SLC25A19 | −0.46604 | −0.57056 | 0.44221 | −0.10224 | −0.52499 |
| TGFB2 | −0.42858 | −0.32116 | 0.77518 | 0.39164 | −0.13126 |
| TNPO2 | −0.48825 | −0.3982 | 0.05747 | 0.11028 | −0.089009 |
| PFKFB2 | −0.19228 | −0.41289 | 0.19562 | 0.30919 | 0.060893 |
| IRX5 | −0.69835 | −0.19189 | 0.18804 | 0.45885 | 0.31132 |
| ATXNIL | −0.6201 | −0.35009 | 0.15427 | 0.13353 | 0.16456 |
| MTM1 | −0.40976 | −0.26259 | 0.13317 | 0.1361 | 0.24181 |
| SLC29A4 | −0.46877 | −0.39549 | 0.27329 | 0.085756 | −0.099932 |
| SLC26A9 | −0.2615 | −0.38022 | 0.2517 | 0.19069 | 0.34778 |
| ABHD15 | −0.38656 | −0.22302 | 0.16024 | 0.39698 | 0.12486 |
| THBS3 | −0.46679 | −0.32766 | 0.23385 | 0.096231 | 0.30097 |
| KCNC2 | −0.47168 | −0.19515 | 0.17283 | 0.29366 | 0.21661 |
| AEN | −0.23665 | −0.42976 | 0.20704 | 0.059962 | 0.17965 |
| SYCP1 | −0.34542 | −0.40661 | 0.065488 | 0.069192 | 0.31255 |
| AKT1 | −0.61632 | −0.32882 | −0.062195 | −0.18312 | −0.024661 |
| PCSK7 | −0.35103 | −0.30993 | −0.018074 | 0.32206 | 0.17071 |
| PHC3 | −0.24422 | −0.41565 | −0.11415 | 0.43889 | 0.086111 |
| SLC5A7 | −0.21869 | −0.5091 | 0.31792 | −0.06088 | 0.34718 |
| HOGA1 | −0.46177 | −0.27652 | 0.016851 | 0.51081 | −0.013044 |
| FEM1B | −0.5793 | −0.44069 | −0.23201 | −0.20174 | −0.10541 |
| CD79B | −0.32611 | −0.61887 | 0.012206 | 0.379 | 0.015003 |
| TUBB1 | −0.2559 | −0.51605 | 0.16645 | 0.20683 | 0.11195 |
| PARD6B | −0.18241 | −1.2316 | 4.98E−05 | −0.092105 | −0.52196 |
| SLC25A24 | −0.29664 | −0.74124 | −0.1252 | 0.016446 | −0.05574 |
| MPO | −0.31137 | −0.71015 | 0.1941 | 0.065629 | −0.14348 |
| ANP32E | −0.33089 | −0.75182 | −0.092957 | 0.38606 | −0.26282 |
| CYP24A1 | −0.067263 | −1.2432 | 0.23309 | −0.10503 | 0.17993 |
| FMO5 | −0.35312 | −0.25021 | 0.12322 | 0.34172 | 0.37529 |
| C17orf82 | 0.03273 | −1.42 | 0.13423 | −0.20641 | 0.19555 |
| PKD1 | −0.34382 | −0.45185 | 0.22619 | 0.19834 | −0.10994 |
| MGRN1 | −0.26919 | −0.36 | 0.053631 | 0.25534 | 0.2701 |
| MRPL27 | −0.57921 | −0.39769 | −0.23484 | −0.18851 | −0.089994 |
| RAB25 | −0.43675 | −0.40859 | 0.53737 | −0.15208 | 0.028645 |
| METTL21D | −0.39295 | −0.33346 | 0.40578 | 0.041981 | −0.3204 |
| PROCA1 | −0.19135 | −0.97535 | −0.028682 | 0.16131 | −0.14679 |
| IGSF3 | −0.46389 | −0.47458 | 0.17558 | −0.026751 | −0.11229 |
| PDCD4 | −0.24152 | −0.4045 | 0.14798 | 0.11064 | −0.14284 |
| MED8 | −0.60166 | −0.6431 | −0.28231 | 0.24517 | −0.21381 |
| ACSM4 | −0.28352 | −0.32231 | 0.086453 | 0.16901 | 0.19928 |
| ARID5A | −0.31034 | −0.47279 | 0.28803 | −0.085089 | 0.039349 |
| BCAS3 | −0.10181 | −0.88567 | 0.35077 | 0.21473 | −0.16356 |
| DPP3 | −0.49637 | −0.32025 | −0.23697 | 0.34466 | −0.33449 |
| PPM1D | −0.29496 | −0.94393 | 0.054948 | −0.66229 | −0.29395 |
| TTYH2 | −0.32027 | −0.41746 | −0.26267 | 0.29674 | −0.21082 |
| DOK5 | −0.21294 | −0.69018 | 0.4516 | 0.16819 | 0.049544 |
| CENPBD1 | −0.3017 | −0.40145 | −0.067585 | −0.046925 | 0.10956 |
| MRPS12 | −0.55887 | −0.7347 | 0.015264 | −0.25734 | 0.20356 |

TABLE 3-continued

| | | | | | |
|---|---|---|---|---|---|
| GRASP | −0.38489 | −0.22942 | 0.28787 | 0.15016 | 0.062742 |
| PRDM12 | −0.14983 | −0.53047 | 0.066436 | 0.45726 | 0.23069 |
| CDK2AP2 | −0.3444 | −0.46233 | −0.071878 | −0.09115 | 0.037976 |
| PCTP | −0.26551 | −0.35728 | 0.078852 | 0.21523 | 0.12034 |
| INO80C | −0.26906 | −0.49662 | 0.033586 | −0.26855 | 0.11162 |
| C17orf49 | −0.21529 | −0.47925 | −0.2413 | −0.30841 | 0.29841 |
| CORO7 | −0.41862 | −0.23573 | 0.06573 | −0.34393 | 0.15446 |
| KATNB1 | −0.26118 | −0.9762 | −0.87808 | −0.28144 | −0.3083 |
| PTRH1 | −0.68782 | −0.17404 | 0.049143 | −0.066333 | −0.25805 |
| BCASI | −0.16274 | −0.72636 | 0.11222 | 0.020849 | 0.5176 |
| NDUFB9 | −0.52691 | −0.54648 | −0.62094 | −0.19318 | −0.38686 |
| CAPZB | −0.84665 | −0.4397 | −0.041887 | 0.19953 | 0.20277 |
| PIAS3 | −0.25898 | −0.53217 | −0.24036 | −0.17644 | 0.10581 |
| CPM | −0.39824 | −0.37777 | −0.19525 | −0.16745 | −0.30829 |
| TAF8 | −0.35094 | −0.87461 | −0.41507 | −0.03282 | −0.028961 |
| TBX10 | −0.2224 | −0.45143 | 0.21898 | −0.041088 | −0.12398 |
| RNF166 | −0.36212 | −0.34518 | −0.10641 | −0.1173 | −0.18482 |
| C3orf38 | −0.19249 | −0.57039 | −0.16652 | 0.12831 | −0.15297 |
| EVPL | −0.40175 | −0.21706 | 0.24988 | 0.29877 | 0.092854 |
| ARGLU1 | −0.89412 | −0.29676 | −0.28456 | −0.48473 | 0.025182 |
| KDM6A | −1.0522 | 0.10874 | 0.366 | 0.64096 | 0.68566 |
| LRRC8A | −0.62956 | −0.15025 | 0.16296 | 0.047991 | 0.28168 |
| RAC3 | −0.22487 | −0.48321 | 0.14411 | −0.21276 | −0.00045631 |
| C1orf56 | −0.21171 | −0.78944 | −0.1554 | 0.020414 | −0.40589 |
| LPO | −0.159 | −0.48364 | −0.10224 | −0.093984 | 0.018747 |
| NRD1 | −0.45015 | −0.3438 | −0.0031464 | 0.09454 | 0.086135 |
| SOAT2 | −0.24503 | −0.36939 | 0.063025 | 0.32471 | 0.25808 |
| DDX42 | −0.49763 | −0.66876 | −0.26595 | −0.012877 | −0.49164 |
| SLC3A2 | −0.79676 | −0.30297 | −0.20675 | −0.30946 | 0.016423 |
| ZMYND11 | −0.41566 | −0.27864 | 0.24996 | −0.25741 | 0.056265 |
| SPATS1 | −0.48638 | −0.15432 | −0.23259 | −0.21507 | 0.36337 |
| CDK5RAP3 | −0.35155 | −0.3512 | 0.10697 | 0.055831 | −0.15499 |
| SNRNP40 | −0.38849 | −0.61166 | −0.35907 | −0.76605 | −0.19847 |
| FBXL12 | −0.17561 | −0.43815 | −0.12229 | 0.37913 | −0.012698 |
| EEF1A2 | −0.44486 | −0.20658 | 0.23408 | 0.72373 | −0.03293 |
| CDC25B | −0.77726 | −0.20236 | 0.043833 | 0.158 | −0.57738 |
| GPR61 | −0.25192 | −0.4737 | 0.10985 | 0.32659 | 0.017491 |
| FAM134C | −0.25466 | −0.48059 | −0.10164 | 0.43118 | −0.38323 |
| SMARCC1 | −0.33795 | −0.40735 | 0.051441 | 0.12428 | 0.32223 |
| BCAR3 | −0.39016 | −0.23381 | 0.049283 | −0.2585 | −0.011448 |
| STIL | −0.47796 | −0.38738 | 0.088108 | 0.20812 | 0.17134 |
| ETNK2 | −0.11519 | −0.56779 | 0.21838 | 0.37731 | 0.085468 |
| GABPB2 | −0.25322 | −0.40956 | 0.11493 | −0.0054792 | 0.36744 |
| NCOA3 | −0.095582 | −0.85922 | 0.054869 | −0.055921 | 0.26651 |
| VPS4A | −0.34838 | −0.38267 | 0.020508 | 0.060644 | 0.24055 |
| ATP8B3 | −0.28452 | −0.45777 | 0.087912 | 0.43278 | 0.095453 |
| NDUFAF3 | −0.76276 | −0.36001 | −0.061408 | −0.9182 | −1.069 |
| CHMP1A | −0.22813 | −0.55459 | −0.13515 | 0.13211 | 0.23061 |
| CABIN1 | −0.79534 | −0.32106 | −0.639 | −0.12701 | 0.029494 |
| TEX19 | −0.35472 | −0.2506 | −0.12328 | 0.054674 | −0.28942 |
| HMBS | −0.52828 | −0.25104 | 0.075708 | −0.044508 | −0.42244 |
| SASS6 | −0.86448 | −0.22537 | −0.20294 | −0.31607 | 0.090874 |
| DET1 | −0.080288 | −0.84165 | −0.39531 | −0.070417 | −0.28196 |
| CHP1 | −0.33189 | −0.51367 | 0.10112 | −0.1847 | −1.0282 |
| TOP1MT | −0.47952 | −0.31453 | 0.098736 | 0.1318 | −0.40956 |
| UBE2G2 | −0.51986 | −0.29411 | −0.31653 | 0.1141 | −0.20526 |
| BRIP1 | 0.0038967 | −1.1531 | −0.16796 | 0.097623 | −0.77203 |
| CDK8 | −0.5683 | −0.15143 | 0.3202 | −0.2077 | 0.24397 |
| PSMC3IP | −0.20841 | −0.43803 | −0.029208 | 0.064607 | −0.019977 |
| REV3L | −0.55902 | −0.42644 | −0.46012 | −0.43413 | −0.085263 |
| IDI1 | −0.32088 | −0.28494 | −0.0014981 | −0.03966 | 0.16607 |
| CNIH2 | −0.49636 | −0.42712 | −0.1361 | −0.20742 | −0.65152 |
| SLC7A6 | −0.47164 | −0.15358 | −0.018338 | 0.21179 | 0.15565 |
| HSF5 | −0.13539 | −0.48966 | −0.12716 | −0.11841 | −0.046991 |
| SMARCD1 | −0.91348 | −0.058718 | −0.11701 | −0.19962 | −0.012692 |
| PSMG4 | −0.47206 | −0.47036 | −0.18445 | −0.46247 | −0.05137 |
| BNIPL | −0.1698 | −0.62119 | −0.0021556 | 0.11861 | −0.0074302 |
| SRA1 | −0.30378 | −0.34229 | −1.2211 | 0.37991 | 0.20612 |
| FNDC3B | −0.34559 | −0.31448 | −0.21829 | 0.092398 | 0.19541 |
| DDRGK1 | −0.61962 | −0.10019 | 0.13289 | 0.11123 | 0.03931 |
| SMCHD1 | −0.64787 | −0.35879 | −0.026647 | 0.14008 | 0.46934 |

| HELA_T18.beta | RPE_T18.beta | DMSO14.beta | KBM7.beta | K562.beta |
|---|---|---|---|---|
| 0.13834 | 0.26324 | 0.14802 | 0.24493 | 0.34726 |
| 0.61303 | 0.46718 | 0.18899 | 0.16554 | 0.3006 |
| 0.10944 | 0.07719 | 0.25321 | 0.3392 | 0.18978 |
| 0.072284 | 0.18147 | 0.070586 | 0.053193 | −0.16559 |
| −0.17546 | −0.21459 | 0.076553 | 0.14161 | 0.33889 |
| −0.054103 | 0.19844 | 0.069996 | −0.1186 | 0.22052 |

TABLE 3-continued

| | | | | |
|---|---|---|---|---|
| 0.0018581 | −0.036934 | −0.39878 | 0.28697 | −0.19102 |
| −0.07994 | 0.14879 | −0.083823 | 0.25819 | 0.0075484 |
| −0.33874 | 0.11967 | −0.39461 | 0.35709 | 0.19631 |
| 0.50686 | 0.47211 | 0.22419 | 0.20846 | 0.072622 |
| −0.2974 | −0.73007 | 0.10152 | −0.42424 | −0.33559 |
| 0.024497 | −0.55737 | −0.62441 | −0.12179 | 0.18838 |
| 0.16935 | 0.065347 | 0.14781 | 0.18774 | 0.13002 |
| −0.022214 | 0.19903 | 0.15748 | 0.11717 | 0.047972 |
| 0.11041 | 0.55851 | −0.1697 | −0.011855 | 0.15642 |
| 0.46834 | 0.43618 | 0.049349 | 0.33124 | 0.032025 |
| −0.16259 | −0.35708 | 0.057335 | −0.047249 | −0.054209 |
| 0.21599 | 0.13949 | 0.072332 | 0.31279 | 0.038848 |
| −0.09518 | −0.17044 | −0.092328 | −0.0063546 | −0.20469 |
| 0.15789 | 0.29652 | 0.13712 | 0.040886 | 0.062227 |
| 0.25952 | 0.25463 | 0.31284 | 0.38472 | 0.0072668 |
| −0.045404 | 0.3386 | −0.16628 | 0.1029 | −0.02185 |
| 0.73814 | 0.5084 | 0.2008 | 0.10759 | 0.17153 |
| 0.21284 | 0.25902 | 0.1764 | 0.25028 | 0.37817 |
| −0.050325 | 0.05576 | 0.066113 | −0.16675 | 0.03833 |
| 0.18995 | 0.15027 | 0.13537 | 0.046536 | −0.13909 |
| 0.22145 | 0.33648 | 0.02003 | 0.16513 | 0.37513 |
| −0.16955 | 0.019842 | −0.14096 | 0.12542 | 0.072465 |
| −0.019403 | 0.29101 | −0.32024 | 0.13138 | 0.30928 |
| 0.51768 | 0.045784 | 0.26073 | 0.36762 | 0.41131 |
| 0.059292 | 0.28354 | 0.32844 | 0.29848 | 0.20175 |
| 0.2141 | −0.11931 | 0.40639 | −0.15528 | 0.045973 |
| 0.48833 | 0.21436 | 0.23755 | 0.049483 | 0.22961 |
| 0.069814 | 0.19018 | −0.0061584 | 0.12418 | −0.42484 |
| 0.077519 | 0.10829 | 0.18815 | 0.21426 | 0.037241 |
| 0.42104 | 0.22581 | 0.22063 | 0.5462 | 0.29431 |
| 0.58637 | 0.29813 | 0.0039383 | 0.10221 | −0.42211 |
| 0.03334 | 0.2736 | −0.19997 | 0.3541 | 0.60428 |
| 0.67291 | 0.0090357 | −0.05876 | 0.22517 | −0.053722 |
| 0.18656 | 0.52929 | 0.028944 | 0.30165 | −0.16415 |
| 0.0078318 | 0.35073 | −0.10208 | 0.14793 | 0.39094 |
| 0.28427 | 0.29198 | −0.21525 | −0.027324 | −0.015434 |
| 0.4026 | 0.11869 | 0.13069 | 0.22671 | −0.068474 |
| −0.0062982 | 0.12001 | −0.1426 | −0.08779 | 0.13636 |
| −0.23447 | −0.22178 | 0.087355 | 0.15927 | −0.22678 |
| 0.11276 | −0.11765 | −0.17022 | −0.032466 | 0.11544 |
| 0.30729 | 0.018422 | 0.15306 | 0.10456 | 0.1264 |
| 0.17613 | 0.60532 | 0.20411 | 0.12046 | 0.20877 |
| 0.53535 | 0.65741 | 0.068111 | 0.12788 | 0.138 |
| 0.15922 | −0.17011 | 0.29953 | −0.03002 | 0.026868 |
| −0.11945 | 0.17452 | −0.66966 | 0.0017554 | 0.26339 |
| 0.1807 | 0.084712 | 0.1035 | 0.16307 | 0.26565 |
| −0.23271 | −0.015874 | 0.011723 | 0.33547 | 0.065985 |
| −0.19368 | −0.21412 | −0.027251 | 0.31267 | 0.4088 |
| 0.1147 | 0.63207 | −0.29902 | 0.19704 | 0.092833 |
| 0.054364 | 0.21598 | 0.34584 | −0.027864 | −0.23328 |
| −0.095693 | 0.03964 | −0.185 | 0.0025644 | −0.10331 |
| 0.053573 | 0.24981 | 0.22623 | 0.068938 | 0.021278 |
| 0.078128 | 0.34545 | −0.31663 | 0.22151 | 0.33265 |
| −0.0044747 | −0.010731 | 0.57632 | 0.11523 | 0.20476 |
| 0.13291 | 0.20007 | −0.5265 | 0.19555 | −0.1679 |
| 0.032138 | −0.26096 | −0.17573 | 0.19354 | 0.052941 |
| 0.28619 | 0.30261 | −0.42416 | −0.1382 | −0.19655 |
| −0.14795 | 0.63989 | −0.13826 | −0.17301 | −0.056082 |
| −0.073419 | −0.068966 | −0.30428 | 0.26304 | 0.13124 |
| 0.20265 | 0.20955 | −0.18493 | 0.084245 | 0.24971 |
| 0.065611 | −0.1557 | 0.03408 | −0.18023 | −0.75213 |
| −0.22803 | −0.16356 | −0.002637 | 0.097837 | 0.1771 |
| −0.06904 | −0.042898 | −0.49244 | −0.40717 | −0.66832 |
| 0.057964 | 0.2483 | −0.43557 | −0.059585 | −0.013003 |
| 0.13027 | −0.068412 | −0.4085 | 0.28157 | −0.15763 |
| 0.48652 | 0.71689 | 0.23065 | 0.10295 | 0.14757 |
| 0.21833 | 0.14795 | −0.086874 | 0.0084499 | −0.41101 |
| 0.25689 | −0.81019 | −0.56407 | 0.1288 | 0.15067 |
| 0.41677 | 0.15981 | 0.12919 | −0.081998 | −0.13723 |
| −0.34837 | −0.14958 | 0.023172 | 0.31578 | 0.098217 |
| 0.30991 | 0.46398 | −0.46306 | 0.17215 | −0.023472 |
| 0.6209 | −0.74557 | −0.34846 | −0.59568 | −0.97012 |
| −0.38489 | 0.1071 | −0.12161 | 0.28319 | 0.10184 |
| 0.0698 | −0.0084232 | 0.5768 | 0.17222 | 0.15179 |
| −0.50792 | 0.40829 | 0.31921 | 0.16174 | −0.26005 |
| 0.32293 | 0.26699 | −0.50137 | 0.19626 | 0.071425 |
| −0.36194 | −0.15109 | 0.21293 | −0.15638 | 0.22418 |
| 0.033797 | 0.071826 | 0.081181 | 0.15074 | 0.021522 |
| 0.368 | 0.83909 | −0.026918 | 0.14669 | 0.27742 |
| −0.36791 | −0.27167 | −0.23722 | −0.37062 | 0.012373 |

TABLE 3-continued

| | | | | |
|---|---|---|---|---|
| −0.11399 | 0.73441 | −0.096641 | 0.22555 | 0.2269 |
| −0.24076 | 0.40542 | 0.086599 | 0.00077598 | −0.045239 |
| 0.30072 | −0.08818 | −0.10701 | −0.2205 | 0.18357 |
| −0.052136 | 0.46955 | −1.424 | −0.52663 | −0.78273 |
| −0.16403 | 0.12292 | −0.19161 | 0.048165 | −0.16393 |
| −0.21593 | −0.25767 | −0.39134 | 0.15397 | 0.14164 |
| −0.15146 | −0.40069 | −0.55546 | −0.53332 | −0.77757 |
| −0.3636 | −0.10034 | 0.1362 | 0.13792 | −0.075878 |
| 1.0305 | 0.61212 | −0.027583 | 0.15147 | 0.079717 |
| 0.035004 | −0.33825 | 0.17231 | 0.29477 | 0.23999 |
| 0.55126 | −0.046326 | 0.31396 | −0.11203 | −0.27869 |
| −0.18913 | −0.87547 | −0.62363 | −0.18173 | −0.18409 |
| 0.12775 | 1.1885 | −0.083577 | 0.18529 | 0.14973 |
| 0.51683 | 0.21503 | −0.29131 | 0.064675 | 0.13478 |
| 0.07249 | 0.49432 | −0.031045 | 0.036141 | −0.16378 |
| −0.069086 | 0.12149 | −0.7403 | 0.020539 | 0.16124 |
| 0.3091 | 0.10027 | 0.041067 | 0.1701 | 0.20085 |
| 0.26044 | −0.35291 | −0.36559 | −0.40788 | −0.38659 |
| −0.21595 | 0.40451 | −0.25774 | −0.012206 | −0.22939 |
| −0.01318 | −0.083596 | −1.4825 | −0.27651 | −0.26088 |
| 0.047221 | −0.25512 | −0.58346 | −0.47421 | −0.41019 |
| 0.2775 | 0.026475 | −0.61349 | 0.019044 | 0.36035 |
| 0.41066 | 0.24933 | −0.096379 | 0.2097 | 0.4046 |
| 0.13811 | 0.36746 | −0.45393 | 0.0082145 | −0.25912 |
| 0.00028582 | −0.37003 | −0.0071207 | −0.39081 | −0.14018 |
| 0.2125 | −0.18162 | 0.36182 | 0.12427 | 0.19033 |
| −0.36159 | 0.021515 | −0.11688 | 0.13756 | −0.011743 |
| −0.3899 | −0.3897 | 0.0062059 | 0.044515 | −0.23449 |
| −0.13328 | 0.35587 | −0.2625 | −0.14396 | −0.33871 |
| 0.038434 | −0.47103 | 0.25607 | 0.12659 | 0.028626 |
| 0.081596 | 0.51856 | −0.016528 | −0.56988 | −0.2426 |
| −0.085091 | −0.058976 | −0.36946 | 0.003645 | −0.11233 |
| 0.40283 | −0.034744 | −0.098569 | −0.43318 | −0.19203 |
| 0.63085 | 0.50585 | −0.1667 | −0.11217 | 0.036308 |
| −0.23841 | −0.14268 | −0.44878 | 0.17243 | −0.0094339 |
| 0.038362 | −0.2631 | −0.035369 | −0.0066132 | 0.056161 |
| −0.11312 | 0.103 | −0.053889 | −0.30797 | −0.62207 |
| 0.61177 | 1.3695 | 0.13415 | −0.17131 | −0.29368 |
| 0.21645 | −0.030764 | 0.27939 | −0.95503 | −0.11404 |
| 0.23982 | 0.47489 | 0.18687 | −0.48118 | −0.53603 |
| 0.3675 | −0.59986 | −1.2043 | −0.057295 | −0.64699 |
| −0.30208 | 0.24271 | 0.18161 | −0.007665 | −0.20447 |
| −0.11506 | 0.085082 | 0.0091259 | −0.46916 | 0.2841 |
| −0.15149 | −1.3426 | −0.71101 | −0.25825 | 0.17693 |
| 0.044882 | −0.24014 | 0.24658 | −0.1664 | 0.54359 |
| −0.18814 | 0.10438 | −0.076723 | 0.066501 | 0.18714 |
| −0.15551 | 0.21124 | −0.33204 | −0.3858 | −0.44893 |
| 0.13077 | 0.23482 | −0.34787 | 0.12986 | −0.036565 |
| 0.30219 | −1.917 | −0.72591 | −0.20244 | 0.044609 |
| 0.035547 | 0.46732 | 0.54678 | 0.51746 | −0.75283 |
| 0.012343 | 0.36176 | −0.61765 | 0.083941 | 0.0017011 |
| −0.39158 | −0.56705 | −0.65962 | −0.40816 | −0.27893 |
| 0.025447 | 0.24254 | −0.58477 | 0.036979 | 0.11491 |
| −0.77668 | −0.13257 | −0.37917 | −0.23981 | −0.30532 |
| 0.19699 | 0.1703 | 0.060897 | 0.031175 | −0.54448 |
| 0.12439 | 0.45081 | −0.14338 | 0.10673 | 0.13871 |
| 0.12139 | 0.82674 | 0.04933 | −0.54111 | −0.86522 |
| −0.20077 | −0.26514 | −0.4202 | −0.62545 | −0.71923 |
| −0.22919 | −0.16223 | −0.42036 | −0.16658 | −0.24757 |
| 0.37165 | 0.35296 | 0.20008 | 0.32758 | 0.37398 |
| −0.72238 | −0.03771 | −0.36793 | 0.1367 | 0.20271 |
| 0.059955 | −0.15327 | 0.068362 | 0.055118 | −0.25995 |
| 0.4914 | 0.6117 | −0.14452 | 0.099622 | −3.6692 |

| Jiyoye.beta | Raji.beta | final_rank_score | p | fdr |
|---|---|---|---|---|
| 0.24637 | 0.021737 | −14.08864744 | 1.15E−05 | 0.001614441 |
| 0.095578 | −0.11767 | −13.85445406 | 1.43E−05 | 0.001614441 |
| 0.48114 | 0.35058 | −11.88220621 | 8.90E−05 | 0.00670812 |
| −0.20789 | −0.20484 | −11.1776564 | 0.000170282 | 0.008106004 |
| 0.33148 | 0.37244 | −11.0401646 | 0.000193175 | 0.008106004 |
| 0.084237 | −0.64787 | −10.79900255 | 0.000240934 | 0.008106004 |
| 0.20161 | 0.31459 | −10.75396585 | 0.000251071 | 0.008106004 |
| 0.12239 | 0.14338 | −10.32938719 | 0.000370008 | 0.009382214 |
| 0.26563 | 0.14711 | −10.22179616 | 0.000408125 | 0.009382214 |
| 0.22097 | 0.14741 | −10.12492845 | 0.000445755 | 0.009382214 |
| −0.56288 | −0.28358 | −10.09837821 | 0.000456656 | 0.009382214 |
| −0.15232 | −0.33931 | −9.768939573 | 0.000615994 | 0.010210019 |
| 0.20283 | 0.15084 | −9.76866245 | 0.000616149 | 0.010210019 |
| 0.062954 | 0.10355 | −9.718848035 | 0.000644623 | 0.010210019 |

TABLE 3-continued

| | | | | |
|---|---|---|---|---|
| 0.15595 | 0.25912 | −9.663717648 | 0.000677656 | 0.010210019 |
| 0.2586 | 0.14076 | −9.454457975 | 0.000818998 | 0.011250981 |
| −0.075182 | −0.38586 | −9.356294097 | 0.000894989 | 0.011250981 |
| 0.14922 | 0.20899 | −9.266351779 | 0.000970713 | 0.011250981 |
| 0.039117 | −0.047631 | −9.201069486 | 0.001029608 | 0.011250981 |
| −0.027902 | 0.018181 | −9.184865548 | 0.001044766 | 0.011250981 |
| 0.21051 | −0.012121 | −9.184144568 | 0.001045445 | 0.011250981 |
| 0.050637 | 0.18524 | −9.129013089 | 0.00109872 | 0.011286853 |
| 0.2335 | 0.055632 | −8.848960161 | 0.00141363 | 0.013216514 |
| 0.23886 | 0.26692 | −8.842062064 | 0.001422418 | 0.013216514 |
| −0.61525 | −0.2299 | −8.738304412 | 0.001561299 | 0.013216514 |
| −0.005861 | −0.1838 | −8.732978781 | 0.001568777 | 0.013216514 |
| 0.24853 | 0.1732 | −8.709134188 | 0.001602698 | 0.013216514 |
| 0.20714 | −0.11914 | −8.685219593 | 0.001637444 | 0.013216514 |
| 0.16733 | 0.11125 | −8.598935224 | 0.001769102 | 0.013786797 |
| 0.17053 | 0.39533 | −8.486169933 | 0.001957015 | 0.014555254 |
| 0.091055 | −0.008984 | −8.463828013 | 0.001996517 | 0.014555254 |
| 0.26632 | 0.12716 | −8.394704889 | 0.002123778 | 0.01480897 |
| 0.17583 | 0.053533 | −8.374548002 | 0.002162372 | 0.01480897 |
| −0.16826 | −0.18254 | −8.258987212 | 0.002397347 | 0.015560305 |
| 0.15338 | 0.13529 | −8.253187145 | 0.002409782 | 0.015560305 |
| 0.43763 | 0.23297 | −8.215122194 | 0.00249298 | 0.015650377 |
| 0.15341 | 0.0056835 | −8.164391646 | 0.002608275 | 0.015931626 |
| 0.22656 | 0.26871 | −8.104151566 | 0.002752017 | 0.016004903 |
| 0.30327 | −0.23523 | −8.100121327 | 0.002761908 | 0.016004903 |
| 0.13933 | 0.0016744 | −8.057995571 | 0.002867405 | 0.01620084 |
| 0.13024 | 0.16012 | −8.010527486 | 0.002991041 | 0.0164872 |
| −0.033525 | −0.23663 | −7.958251613 | 0.003133275 | 0.016860003 |
| 0.13457 | 0.17336 | −7.878493695 | 0.003363202 | 0.017676364 |
| 0.25182 | 0.083278 | −7.847126976 | 0.003458106 | 0.017762091 |
| 0.001896 | 0.15909 | −7.788881537 | 0.003641374 | 0.018036118 |
| −0.099806 | −0.20361 | −7.77200937 | 0.003696224 | 0.018036118 |
| −0.051426 | −0.32075 | −7.755441826 | 0.003750874 | 0.018036118 |
| −0.0026299 | 0.11999 | −7.702540027 | 0.00393075 | 0.01850728 |
| 0.13805 | 0.12433 | −7.626398322 | 0.00420462 | 0.018989681 |
| 0.17262 | −0.01752 | −7.621639087 | 0.004222348 | 0.018989681 |
| 0.1676 | 0.12528 | −7.604775858 | 0.004285755 | 0.018989681 |
| −0.028448 | −0.5424 | −7.582925667 | 0.004369307 | 0.018989681 |
| 0.13491 | −0.056265 | −7.539891236 | 0.004538572 | 0.019157404 |
| 0.13404 | 0.034379 | −7.518990723 | 0.004623086 | 0.019157404 |
| 0.096726 | −0.016444 | −7.509444458 | 0.0046622 | 0.019157404 |
| −0.16526 | −0.31319 | −7.405286408 | 0.005110666 | 0.020625186 |
| −0.032446 | −0.29582 | −7.35888975 | 0.00532382 | 0.02110848 |
| 0.10495 | 0.059712 | −7.308630844 | 0.005564568 | 0.021406524 |
| 0.18745 | −0.041915 | −7.303766263 | 0.005588429 | 0.021406524 |
| 0.25104 | 0.12939 | −7.274562024 | 0.005733804 | 0.02159733 |
| 0.0048835 | 0.10492 | −7.210206552 | 0.00606738 | 0.022479144 |
| 0.032048 | −0.072433 | −7.143382316 | 0.006433885 | 0.023452549 |
| −0.36662 | −0.15588 | −7.044529714 | 0.007016173 | 0.025169128 |
| −0.10051 | −0.11438 | −7.0093051 | 0.007235896 | 0.025551757 |
| 0.10166 | 0.12889 | −6.971475734 | 0.007479375 | 0.02600521 |
| −0.29516 | −0.25445 | −6.951634012 | 0.00761027 | 0.026059411 |
| −0.034906 | −0.27377 | −6.906849563 | 0.007914014 | 0.026319563 |
| −0.052957 | 0.15013 | −6.90610538 | 0.007791916 | 0.026319563 |
| −0.7936 | −0.75965 | −6.852608122 | 0.00829782 | 0.026966694 |
| 0.10929 | 0.098742 | −6.817001649 | 0.008559611 | 0.026966694 |
| 0.098129 | −0.23217 | −6.814832231 | 0.008575819 | 0.026966694 |
| 0.082763 | 0.16955 | −6.812782843 | 0.008591159 | 0.026966694 |
| 0.13113 | 0.15093 | −6.778765958 | 0.008849731 | 0.027146983 |
| 0.24447 | −0.0085991 | −6.773706316 | 0.008888835 | 0.027146983 |
| −0.046848 | −0.21148 | −6.724707538 | 0.009276383 | 0.027658146 |
| 0.075316 | 0.11375 | −6.7216669 | 0.009300969 | 0.027658146 |
| 0.2596 | −0.028075 | −6.699203599 | 0.009484592 | 0.027837893 |
| −0.6274 | −0.79784 | −6.634614941 | 0.01003253 | 0.028688103 |
| 0.11746 | 0.20177 | −6.631326712 | 0.010061239 | 0.028688103 |
| 0.13662 | −0.03645 | −6.616881287 | 0.01018831 | 0.028688103 |
| 0.031111 | −0.16864 | −6.60634085 | 0.010282019 | 0.028688103 |
| 0.050786 | −0.047693 | −6.503366365 | 0.011242943 | 0.030738611 |
| 0.091446 | −0.0051805 | −6.489002719 | 0.01138376 | 0.030738611 |
| 0.26621 | 0.1897 | −6.484832563 | 0.011424971 | 0.030738611 |
| 0.068722 | 0.23429 | −6.462138155 | 0.011651782 | 0.030838543 |
| −0.094808 | −0.010124 | −6.453917393 | 0.011735021 | 0.030838543 |
| 0.27606 | 0.33073 | −6.413875135 | 0.012148837 | 0.030895436 |
| 0.012015 | 0.0012283 | −6.413765492 | 0.012149989 | 0.030895436 |
| −0.81661 | −0.44395 | −6.396483393 | 0.012332975 | 0.030895436 |
| −0.98515 | −0.7146 | −6.385188396 | 0.012454018 | 0.030895436 |
| 0.010475 | −0.21507 | −6.380068402 | 0.012509268 | 0.030895436 |
| 0.24409 | 0.093037 | −6.373830533 | 0.012576903 | 0.030895436 |
| −0.30232 | −0.52481 | −6.324740756 | 0.013121765 | 0.031887299 |
| 0.14488 | 0.1064 | −6.297899718 | 0.013429344 | 0.032287572 |

TABLE 3-continued

| | | | | |
|---|---|---|---|---|
| 0.14811 | 0.030897 | −6.271558913 | 0.013738019 | 0.032682023 |
| 0.069398 | 0.1403 | −6.227155798 | 0.014274076 | 0.033167878 |
| −0.072741 | 0.048079 | −6.226460362 | 0.014282632 | 0.033167878 |
| 0.057035 | −0.33588 | −6.218370095 | 0.014382531 | 0.033167878 |
| 0.44248 | 0.24346 | −6.198720064 | 0.014628014 | 0.033361778 |
| −0.02771 | −0.13934 | −6.165892993 | 0.015047246 | 0.033361778 |
| −0.099093 | −0.17121 | −6.165253959 | 0.015055522 | 0.033361778 |
| 0.092735 | 0.23741 | −6.165133243 | 0.015057086 | 0.033361778 |
| 0.15316 | −0.17485 | −6.129463692 | 0.01552618 | 0.034067151 |
| 0.1817 | 0.048907 | −6.113436157 | 0.015741563 | 0.034110403 |
| 0.043494 | 0.13798 | −6.105612476 | 0.015847754 | 0.034110403 |
| −0.27649 | −0.39366 | −6.085293672 | 0.016126807 | 0.034151594 |
| −0.34178 | −0.39973 | −6.08224284 | 0.016169117 | 0.034151594 |
| 0.10855 | 0.26295 | −6.064585497 | 0.016416126 | 0.034352263 |
| 0.088971 | 0.14871 | −6.023722749 | 0.017001914 | 0.035037322 |
| −0.086113 | −0.26211 | −6.020185746 | 0.017053564 | 0.035037322 |
| −0.52141 | −0.057158 | −5.980233178 | 0.017647682 | 0.035897882 |
| −0.048421 | −0.1606 | −5.970850314 | 0.017790101 | 0.035897882 |
| 0.13734 | 0.34389 | −5.936497446 | 0.018321125 | 0.036642251 |
| 0.019876 | −0.092 | −5.898755339 | 0.018922297 | 0.037512623 |
| 0.03349 | −0.28079 | −5.886104116 | 0.019128065 | 0.037590807 |
| 0.06246 | −0.19181 | −5.828528091 | 0.020092293 | 0.038650367 |
| −0.47192 | 0.099256 | −5.825973811 | 0.020136145 | 0.038650367 |
| 0.17552 | −0.042525 | −5.818755316 | 0.020260576 | 0.038650367 |
| −0.71617 | −0.53006 | −5.807236632 | 0.020460683 | 0.038650367 |
| 0.050734 | −0.1553 | −5.803710378 | 0.020522319 | 0.038650367 |
| −0.16738 | 0.052102 | −5.780571632 | 0.020931288 | 0.03900511 |
| −0.55942 | −0.15045 | −5.765096311 | 0.021209209 | 0.03900511 |
| −0.19123 | −0.20174 | −5.760374197 | 0.021294724 | 0.03900511 |
| −0.19499 | −0.30445 | −5.750376593 | 0.021476879 | 0.03900511 |
| −0.73609 | −0.12793 | −5.745100218 | 0.021573623 | 0.03900511 |
| −0.058196 | −0.12154 | −5.731627895 | 0.021822562 | 0.039026584 |
| −0.21258 | −0.4712 | −5.717058226 | 0.022094912 | 0.039026584 |
| −0.042781 | −0.050534 | −5.716598849 | 0.022103552 | 0.039026584 |
| −0.084803 | −0.26759 | −5.707277157 | 0.022279594 | 0.039032467 |
| −0.14701 | 0.053079 | −5.696463333 | 0.022485518 | 0.039090209 |
| 0.037168 | 0.060195 | −5.679484996 | 0.022812558 | 0.039356016 |
| 0.0069384 | −0.17514 | −5.657859752 | 0.023235786 | 0.039455239 |
| 0.0027806 | −0.22353 | −5.651011661 | 0.023371389 | 0.039455239 |
| −0.79914 | 0.068016 | −5.64988287 | 0.023393815 | 0.039455239 |
| −0.046662 | −0.18054 | −5.629414458 | 0.023804087 | 0.039849806 |
| 0.09735 | 0.086954 | −5.609889052 | 0.024201947 | 0.040217942 |
| 0.02325 | 0.17406 | −5.591567678 | 0.024581123 | 0.040448887 |
| −0.43626 | −0.063512 | −5.585933573 | 0.024698878 | 0.040448887 |
| −0.16684 | −0.11067 | −5.571704283 | 0.024998709 | 0.040645384 |
| 0.016768 | −0.19867 | −5.552779712 | 0.02540294 | 0.041007603 |
| 0.045412 | 0.041675 | −5.520497125 | 0.026107138 | 0.041845484 |
| −0.029322 | −0.056678 | −5.511054492 | 0.02631666 | 0.041884262 |
| 0.084249 | −0.43235 | −5.446021538 | 0.027804472 | 0.043942732 |
| −0.42061 | −0.31065 | −5.383682298 | 0.029306756 | 0.045728574 |
| 0.034286 | −0.14772 | −5.382373185 | 0.029339129 | 0.045728574 |
| 0.44995 | 0.26012 | −5.367170772 | 0.029717608 | 0.046001229 |
| 0.39004 | 0.26783 | −5.332696572 | 0.030593417 | 0.047034777 |
| 0.13835 | −0.35652 | −5.297490852 | 0.03151349 | 0.048068877 |
| 0.18472 | 0.36873 | −5.290796795 | 0.031691428 | 0.048068877 |

TABLE 4

| Gene Set Name [# Genes K] | Description | p-value | FDRq-value |
|---|---|---|---|
| LIEN_BREAST_CARCINOMA_METAPLASTIC_VS_DS_DUCTAL_ON [114] | metaplastic (MOB) and ductal (DCB). | $6.22e^{-10}$ | $2.36e^{-6}$ |
| CHARAFE_BREAST_CANCER_LUMINAL_VS_BASAL_UP [380] | compared to the basal-like ones. | $9.99e^{-10}$ | $2.36e^{-6}$ |
| CHARAFE_BREAST_CANCER_LUMINAL_VS_MESENCHYMAL_UP [450] | compared to the mesenchymal-like ones. | $3.75e^{-9}$ | $5.9e^{-6}$ |
| MCBRYAN_PUBERTAL_BREAST_4_5WK_UP [271] | Genes up-regulated during pubertal mammary gland development between week 4 and 5. | $1.1e^{-7}$ | $1.3e^{-4}$ |
| GOZGIT_ESR1_TARGETS_DN [781] | Genes down-regulated in TMX2-28 cells (breast cancer) which do not express ESR1 [GeneID = 2099]) compared to the parental MCF7 cells which do. | $2.59e^{-7}$ | $2.45e^{-4}$ |
| VANTVEER_BREAST_CANCER_ESR1_UP [167] | Up-regulated genes from the optimal set of 550 markers discriminating breast cancer samples by ESR1 [GeneID = 2099] expression: ER(+) vs ER(−) tumors. | $3.11e^{-7}$ | $2.45e^{-4}$ |

TABLE 4-continued

| Gene Set Name [# Genes K] | Description | p-value | FDRq-value |
|---|---|---|---|
| SMID_BREAST_CANCER_RELAPSE_IN_BRAIN_DN [85] | Genes down-regulated in brain relapse of breast cancer. | $6.53e^{-7}$ | $5.76e^{-4}$ |
| DOANE_BREAST_CANCER_ESR1_UP [112] | Genes up-regulated in breast cancer samples positive for ESR1 [GeneID = 2099] compared to the ESR1 negative tumors. | $2.57e^{-6}$ | $1.52e^{-3}$ |
| CREIGHTON_ENDOCRINE_THERAPY_RESISTANCE_1 [528] | therapy resistance in breast tumors expressing ESR1 and ERBB2 | $5.29e^{-6}$ | $2.78e^{-3}$ |
| FARMER_BREAST_CANCER_APOCRINE_VS_LUMINAL [326] | cancer according to the status of ESR1 and AR | $8.23e^{-6}$ | $3.89e^{-3}$ |

TABLE 5

T47D

| Genes | sgRNAs | lo_value | p | FDR | good-sgrna |
|---|---|---|---|---|---|
| CSK | 6 | 4.85E-15 | 2.27E-07 | 0.00056161 | 6 |
| NF2 | 6 | 1.79E-13 | 2.27E-07 | 0.00056161 | 6 |
| TSC2 | 6 | 8.51E-11 | 2.27E-07 | 0.00056161 | 5 |
| RALGAPB | 6 | 2.59E-09 | 2.27E-07 | 0.00056161 | 4 |
| MED12 | 6 | 3.77E-09 | 2.27E-07 | 0.00056161 | 5 |
| RALGAPA1 | 6 | 7.71E-07 | 5.22E-06 | 0.00922641 | 4 |
| LATS2 | 6 | 8.05E-07 | 5.22E-06 | 0.00922641 | 6 |
| CDC42 | 6 | 2.32E-06 | 1.66E-05 | 0.02562346 | 4 |
| RARS2 | 6 | 4.14E-06 | 2.66E-05 | 0.03650467 | 6 |
| LRRC26 | 6 | 5.92E-06 | 3.65E-05 | 0.04520695 | 5 |
| LGALS3 | 6 | 7.49E-06 | 4.56E-05 | 0.04937432 | 4 |
| NF1 | 6 | 8.20E-06 | 4.79E-05 | 0.04937432 | 3 |
| AMOTL2 | 6 | 9.77E-06 | 5.61E-05 | 0.05335288 | 5 |
| RNF7 | 6 | 1.40E-05 | 8.15E-05 | 0.0717808 | 5 |
| USP9X | 6 | 1.62E-05 | 9.24E-05 | 0.0717808 | 6 |
| HSD17B10 | 6 | 1.64E-05 | 9.28E-05 | 0.0717808 | 6 |
| USP22 | 6 | 1.97E-05 | 0.00011369 | 0.08275294 | 4 |
| AP2S1 | 6 | 2.11E-05 | 0.00012322 | 0.0847069 | 5 |
| SNAPC2 | 6 | 2.70E-05 | 0.00015318 | 0.09505088 | 5 |
| GLMN | 6 | 2.71E-05 | 0.00015363 | 0.09505088 | 5 |
| KDM6A | 6 | 3.01E-05 | 0.007088 | 0.0979299 | 5 |
| MYH9 | 6 | 3.37E-05 | 0.00018404 | 0.0979299 | 3 |
| PTEN | 6 | 3.49E-05 | 0.00018767 | 0.0979299 | 2 |
| SPRED2 | 6 | 3.55E-05 | 0.00018994 | 0.0979299 | 4 |
| NT5C3A | 6 | 4.42E-05 | 0.00022988 | 0.1137814 | 6 |
| SARS2 | 6 | 5.01E-05 | 0.00025394 | 0.12085591 | 5 |
| RBM47 | 6 | 5.31E-05 | 0.00026846 | 0.12303422 | 6 |
| CDKN1B | 6 | 6.11E-05 | 0.00030068 | 0.12908078 | 6 |
| FZR1 | 6 | 6.45E-05 | 0.00031339 | 0.12908078 | 3 |
| FAM103A1 | 6 | 6.66E-05 | 0.00032247 | 0.12908078 | 3 |
| TCF712 | 6 | 6.70E-05 | 0.00032338 | 0.12908078 | 6 |
| CDK8 | 6 | 7.51E-05 | 0.00036468 | 0.13503309 | 5 |
| COX7A1 | 6 | 7.53E-05 | 0.00036649 | 0.13503309 | 2 |
| FBXW11 | 6 | 7.64E-05 | 0.00037103 | 0.13503309 | 4 |
| ZNF677 | 6 | 8.79E-05 | 0.00042368 | 0.14978904 | 4 |
| NBN | 6 | 0.00010258 | 0.00049539 | 0.17027655 | 3 |
| KRTAP21-2 | 6 | 0.00011018 | 0.00053533 | 0.17903171 | 6 |
| BUD31 | 6 | 0.00011465 | 0.0005612 | 0.18274444 | 3 |
| TBCD | 6 | 0.00012384 | 0.00060886 | 0.19129895 | 5 |
| TAB1 | 6 | 0.00012556 | 0.00061839 | 0.19129895 | 5 |
| TOE1 | 6 | 0.00013533 | 0.00066831 | 0.20169922 | 4 |
| PAXIP1 | 6 | 0.00016222 | 0.00077815 | 0.21963365 | 3 |
| PRKRIP1 | 6 | 0.0001624 | 0.00077905 | 0.21963365 | 6 |
| RPRD1B | 6 | 0.00016414 | 0.00078813 | 0.21963365 | 5 |
| MECR | 6 | 0.00017279 | 0.00082898 | 0.21963365 | 5 |
| GPRASP2 | 6 | 0.00017578 | 0.00084396 | 0.21963365 | 2 |
| NDUFA1 | 6 | 0.00017805 | 0.00085848 | 0.21963365 | 5 |
| ABCA8 | 6 | 0.00017908 | 0.00086302 | 0.21963365 | 6 |
| MRPL21 | 6 | 0.00018418 | 0.00088889 | 0.21963365 | 5 |
| SAV1 | 6 | 0.00018586 | 0.00090023 | 0.21963365 | 3 |
| A3GALT2 | 6 | 0.00018674 | 0.00090523 | 0.21963365 | 4 |
| CSK | 6 | 9.45E-13 | 2.27E-07 | 0.002717714 | 6 |
| UBP1 | 6 | 3.63E-07 | 2.50E-06 | 0.014947246 | 4 |
| SIRT1 | 6 | 7.06E-06 | 3.43E-05 | 0.122750008 | 5 |
| CHD8 | 6 | 8.76E-06 | 4.11E-05 | 0.122750008 | 6 |
| EPB41 | 6 | 1.15E-05 | 5.56E-05 | 0.122750008 | 4 |
| AGO1 | 6 | 1.29E-05 | 6.15E-05 | 0.122750008 | 5 |
| NCAM2 | 6 | 1.97E-05 | 9.87E-05 | 0.15191556 | 6 |
| VPS33B | 6 | 2.05E-05 | 0.00010189 | 0.15191556 | 4 |
| ZFX | 6 | 2.35E-05 | 0.00011778 | 0.15191556 | 4 |
| RGS16 | 6 | 2.51E-05 | 0.00012685 | 0.15191556 | 2 |
| TAS2R14 | 6 | 3.40E-05 | 0.00016725 | 0.182089636 | 5 |

TABLE 6

|  | baseMean | log2FoldChange | lfcSE | stat |
|---|---|---|---|---|
| ENSG00000167653 | 1368.185556 | -5.721402209 | 0.19449129 | -29.41726699 |
| ENSG00000170099 | 1061.22389 | -5.828239528 | 0.223693908 | -26.05452956 |
| ENSG00000131747 | 7196.349951 | 4.921540234 | 0.197304774 | 24.94384773 |
| ENSG00000165272 | 3513.531965 | -4.066642206 | 0.175019005 | -23.23543213 |
| ENSG00000117724 | 7620.535117 | 5.18198084 | 0.224459657 | 23.08646868 |
| ENSG00000058673 | 5882.881374 | 4.229730958 | 0.183886863 | 23.00181145 |
| ENSG00000047410 | 6655.174067 | 4.951702266 | 0.221739263 | 22.33119299 |
| ENSG00000137975 | 10080.88835 | 4.504100686 | 0.20613215 | 21.85054921 |
| ENSG00000214708 | 939.8771604 | -4.153587722 | 0.190949667 | -21.75226483 |
| ENSG00000133706 | 5914.420813 | 3.660854417 | 0.171710837 | 21.31987986 |
| ENSG00000106211 | 40081.82269 | -3.355805732 | 0.160700462 | -20.88236519 |
| ENSG00000148773 | 4897.19406 | 5.758250375 | 0.276970216 | 20.79014289 |
| ENSG00000092201 | 2956.162233 | 4.1571619 | 0.202795819 | 20.49924858 |
| ENSG00000100941 | 3789.565319 | 3.606348695 | 0.180445479 | 19.98580795 |
| ENSG00000197249 | 2869.682188 | -3.625197553 | 0.181568945 | -19.9659559 |
| ENSG00000173230 | 6474.102779 | 4.654287199 | 0.238163885 | 19.54237184 |
| ENSG00000162078 | 4282.006105 | -3.148965007 | 0.161981128 | -19.44032034 |
| ENSG00000155561 | 2752.844272 | 4.373625429 | 0.225643587 | 19.38289267 |
| ENSG00000253729 | 15958.3611 | 4.242772589 | 0.21983649 | 19.29967398 |
| ENSG00000173193 | 2898.655539 | 4.088608457 | 0.214988637 | 19.01778862 |
| ENSG00000102003 | 804.1012868 | -3.843892492 | 0.202316666 | -18.99938627 |

TABLE 6-continued

| | | | | |
|---|---|---|---|---|
| ENSG00000009954 | 3793.665919 | 3.611270541 | 0.190105945 | 18.99609473 |
| ENSG00000186160 | 2557.208014 | 4.141456414 | 0.221310142 | 18.71336023 |
| ENSG00000175216 | 7564.354675 | 3.44501511 | 0.185013253 | 18.6203694 |
| ENSG00000104517 | 5084.540535 | 4.086266259 | 0.220868059 | 18.50093796 |
| ENSG00000168539 | 2647.770643 | −3.122482366 | 0.169424353 | −18.42995011 |
| ENSG00000119231 | 2715.324661 | 3.614736525 | 0.196588667 | 18.38730881 |
| ENSG00000138246 | 2347.309166 | 4.616050746 | 0.251707094 | 18.33897754 |
| ENSG00000090661 | 3403.830408 | −3.02038727 | 0.165171689 | −18.28634972 |
| ENSG00000182481 | 4305.476938 | 3.476375018 | 0.192155089 | 18.0915064 |
| ENSG00000124486 | 5066.540256 | 3.715634526 | 0.206546497 | 17.98933696 |
| ENSG00000064651 | 3874.162948 | 3.552772021 | 0.198320945 | 17.91425522 |
| ENSG00000144674 | 6567.961767 | 3.450254523 | 0.192876931 | 17.8883732 |
| ENSG00000114346 | 5221.674058 | 3.283118037 | 0.183787411 | 17.86367204 |
| ENSG00000008196 | 6137.96058 | 3.3618457 | 0.188226142 | 17.86067367 |
| ENSG00000055332 | 2595.590078 | 3.487262789 | 0.19604346 | 17.78821278 |
| ENSG00000182670 | 15625.88958 | 3.592592082 | 0.202032892 | 17.78221382 |
| ENSG00000198125 | 1713.730133 | −3.517723504 | 0.198288348 | −17.7404449 |
| ENSG00000104419 | 6676.608434 | −3.199706594 | 0.181097175 | −17.66845114 |
| ENSG00000140575 | 3840.709404 | 4.115410842 | 0.233384797 | 17.63358577 |
| ENSG00000183569 | 1262.372002 | −3.105545282 | 0.176291092 | −17.616008 |
| ENSG00000189057 | 1780.869777 | 4.561476957 | 0.258965582 | 17.61422085 |
| ENSG00000166801 | 4477.438383 | 3.396096675 | 0.192854744 | 17.6096092 |
| ENSG00000151914 | 6245.70821 | 4.403575892 | 0.250187893 | 17.60107509 |
| ENSG00000258486 | 5336.608896 | 3.203961996 | 0.18291978 | 17.51566721 |
| ENSG00000145833 | 2895.447246 | 3.253011878 | 0.186052553 | 17.48437104 |
| ENSG00000107290 | 4881.318064 | 3.785570219 | 0.218047328 | 17.36123184 |
| ENSG00000115221 | 1575.187097 | 4.549374113 | 0.262335286 | 17.34183069 |
| ENSG00000156802 | 4005.299253 | 3.328992005 | 0.192045699 | 17.33437416 |
| ENSG00000125107 | 4448.187748 | 3.674398534 | 0.212304594 | 17.30720222 |
| ENSG00000120800 | 1613.302241 | 4.639722642 | 0.268587246 | 17.27454564 |
| ENSG00000164171 | 1702.082663 | 4.177415872 | 0.242568152 | 17.22161727 |
| ENSG00000196914 | 7623.881833 | 3.75573128 | 0.218640192 | 17.17768012 |
| ENSG00000251562 | 20804.03928 | 2.877209187 | 0.16766086 | 17.16088766 |
| ENSG00000196712 | 4867.883217 | 4.479947546 | 0.261244276 | 17.1485003 |
| ENSG00000165733 | 2392.007464 | 3.292074895 | 0.193093329 | 17.04913844 |
| ENSG00000135679 | 4501.975666 | 2.935839346 | 0.173553154 | 16.91608181 |
| ENSG00000108424 | 7929.244344 | 2.652475025 | 0.15706811 | 16.88741927 |
| ENSG00000169045 | 7157.831453 | 2.680355016 | 0.158793423 | 16.87950899 |
| ENSG00000153201 | 2524.765817 | 4.073502046 | 0.241602936 | 16.8603168 |
| ENSG00000163781 | 1928.748455 | 3.884857036 | 0.230515215 | 16.85293109 |
| ENSG00000157106 | 4544.821236 | 4.192296628 | 0.248880427 | 16.84462165 |
| ENSG00000078124 | 1578.814599 | 3.913863552 | 0.232401967 | 16.84092263 |
| ENSG00000198363 | 6390.846194 | 3.087620418 | 0.183684264 | 16.80938995 |
| ENSG00000153207 | 2304.557259 | 3.641664411 | 0.216784206 | 16.79856884 |
| ENSG00000143416 | 8258.267274 | −2.832656094 | 0.169906773 | −16.67182562 |
| ENSG00000165671 | 3487.051431 | 3.816207098 | 0.229592617 | 16.62164551 |
| ENSG00000163840 | 2185.907817 | 3.385994506 | 0.204203647 | 16.58145951 |
| ENSG00000147862 | 4869.171989 | 3.420082263 | 0.206315828 | 16.57692628 |
| ENSG00000124151 | 3334.218891 | 3.646105879 | 0.220289503 | 16.55142817 |
| ENSG00000108055 | 1592.99049 | 3.67107614 | 0.222605372 | 16.49140858 |
| ENSG00000114857 | 4671.548444 | 4.138381357 | 0.251567873 | 16.45035713 |
| ENSG00000178202 | 3666.856901 | 3.033346701 | 0.184543484 | 16.43702953 |
| ENSG00000101868 | 1303.280929 | 4.525171871 | 0.275519818 | 16.42412481 |
| ENSG00000119969 | 1761.701777 | 3.470475501 | 0.211372625 | 16.41875573 |
| ENSG00000154198 | 2239.956903 | 3.429761907 | 0.209447368 | 16.37529246 |
| ENSG00000094916 | 9294.009805 | 3.4110301 | 0.209091451 | 16.3135799 |
| ENSG00000138160 | 2918.828216 | 3.32018146 | 0.203987862 | 16.27636778 |
| ENSG00000196074 | 4746.599819 | 3.074251077 | 0.189134426 | 16.25431783 |
| ENSG00000167608 | 5117.76345 | −2.50524823 | 0.154145161 | −16.25252596 |
| ENSG00000153914 | 3161.703553 | 3.234786517 | 0.199067222 | 16.24971951 |
| ENSG00000121892 | 3282.905321 | 3.226025025 | 0.198907084 | 16.21875383 |
| ENSG00000099194 | 8239.016637 | 3.003672323 | 0.185537783 | 16.18900622 |
| ENSG00000180182 | 2295.052411 | 3.244927987 | 0.200893769 | 16.15245709 |
| ENSG00000108256 | 3962.31411 | 3.128116391 | 0.193744794 | 16.14555066 |
| ENSG00000163435 | 4041.93303 | −2.763914635 | 0.17120303 | −16.14407542 |
| ENSG00000164684 | 4117.937816 | 4.010335 | 0.248478611 | 16.13955817 |
| ENSG00000066777 | 3857.010695 | 3.231067105 | 0.200366668 | 16.1257699 |
| ENSG00000171634 | 3076.937442 | 4.0582304 | 0.252506697 | 16.07177334 |
| ENSG00000163714 | 4344.038433 | 2.759488116 | 0.172193815 | 16.02547751 |
| ENSG00000143476 | 1292.248553 | 4.205858503 | 0.262893238 | 15.9983518 |
| ENSG00000030066 | 2545.340887 | 2.965374133 | 0.185384726 | 15.99578456 |
| ENSG00000198408 | 4835.003717 | 2.865092361 | 0.179161153 | 15.99170534 |
| ENSG00000138758 | 1979.702561 | 3.277970063 | 0.205592533 | 15.94401325 |
| ENSG00000117523 | 6850.585766 | 3.763491446 | 0.236609174 | 15.90594054 |
| ENSG00000151461 | 1628.973375 | 3.355141253 | 0.211015742 | 15.89995712 |
| ENSG00000106261 | 6305.539237 | 3.121630986 | 0.196406343 | 15.89373813 |
| ENSG00000225339 | 2002.431202 | 3.138444607 | 0.197496483 | 15.89114176 |
| ENSG00000111335 | 5802.105793 | 3.039119433 | 0.191394234 | 15.8788453 |
| ENSG00000143324 | 1701.540791 | 3.334110192 | 0.21007145 | 15.8713152 |
| ENSG00000198625 | 2614.854304 | 2.892113536 | 0.182418353 | 15.85429037 |

TABLE 6-continued

| | | | | |
|---|---|---|---|---|
| ENSG00000124831 | 2383.993282 | 3.129647767 | 0.19751668 | 15.84497964 |
| ENSG00000158711 | 1813.277367 | 3.239978021 | 0.20460353 | 15.83539651 |
| ENSG00000116539 | 3309.398334 | 4.210868598 | 0.266718271 | 15.78770206 |
| ENSG00000171316 | 1349.884242 | 4.084891519 | 0.25933995 | 15.75110782 |
| ENSG00000113013 | 7472.050606 | 2.52945731 | 0.160710037 | 15.73926152 |
| ENSG00000198589 | 4983.092653 | 3.716331506 | 0.236276802 | 15.72871933 |
| ENSG00000141367 | 17225.05519 | 2.592209106 | 0.165106489 | 15.70022544 |
| ENSG00000126777 | 11107.99487 | 2.846655603 | 0.181473073 | 15.6863801 |
| ENSG00000164190 | 2794.506864 | 3.818505925 | 0.244184752 | 15.6377738 |
| ENSG00000109586 | 1802.05793 | 3.392686313 | 0.217429003 | 15.60365114 |
| ENSG00000119707 | 4239.91501 | 2.757549639 | 0.177368219 | 15.54703345 |
| ENSG00000197599 | 702.2613199 | −3.546941928 | 0.228763869 | −15.50481701 |
| ENSG00000181555 | 2032.509809 | 3.783711847 | 0.24444781 | 15.47860807 |
| ENSG00000146918 | 1154.991385 | 4.071946649 | 0.263451805 | 15.45613492 |
| ENSG00000048649 | 2008A56037 | 3.427289509 | 0.221986048 | 15.43921135 |
| ENSG00000166181 | 3254.95912 | 2.755567757 | 0.178609403 | 15.42789863 |
| ENSG00000175054 | 2286.859 | 3.445518211 | 0.223754033 | 15.39868651 |
| ENSG00000075292 | 2388.213081 | 3.031866124 | 0.197215767 | 15.37334553 |
| ENSG00000170759 | 4553.148959 | 2.735666531 | 0.178026339 | 15.36663931 |
| ENSG00000113300 | 2283.297288 | 2.918789014 | 0.190420387 | 15.32813296 |
| ENSG00000159140 | 10123.27034 | 3.000058351 | 0.195892106 | 15.31485069 |
| ENSG00000100100 | 943.3853559 | −2.888361581 | 0.188844422 | −15.29492667 |
| ENSG00000187244 | 16687.83436 | −2.369977407 | 0.155050256 | −15.28522087 |
| ENSG00000148671 | 6184.903787 | −2.711810435 | 0.177844182 | −15.24823814 |
| ENSG00000025796 | 2371.828251 | 2.775273194 | 0.182647886 | 15.19466364 |
| ENSG00000067704 | 5360.915397 | 2.450683092 | 0.16142474 | 15.18158302 |
| ENSG00000075539 | 1434.124314 | 4.369480436 | 0.2888488 | 15.12722378 |
| ENSG00000080345 | 1601.57042 | 3.595349509 | 0.238198786 | 15.09390359 |
| ENSG00000069248 | 2045.675974 | 2.845461197 | 0.189322918 | 15.02967112 |
| ENSG00000069431 | 1075.673892 | 4.08490518 | 0.272268149 | 15.00324295 |
| ENSG00000125676 | 1836.833575 | 3.439872105 | 0.229278301 | 15.00304256 |
| ENSG00000139697 | 3394.931601 | 2.824966281 | 0.188310772 | 15.00161809 |
| ENSG00000060749 | 1869.275025 | 3.828325792 | 0.255273163 | 14.99697713 |
| ENSG00000138688 | 2234.204822 | 4.51506849 | 0.301107237 | 14.99488534 |
| ENSG00000162599 | 3527.746857 | 2.66212026 | 0.177759906 | 14.97593198 |
| ENSG00000183530 | 1401.199044 | 3.714227104 | 0.248156074 | 14.96730282 |
| ENSG00000175567 | 4627.608912 | −2.325635082 | 0.155447782 | −14.96087655 |
| ENSG00000115464 | 3139.748631 | 3.360400182 | 0.224692662 | 14.9555404 |
| ENSG00000165219 | 2887.371411 | 2.883633606 | 0.19294071 | 14.94569809 |
| ENSG00000259758 | 1857.794342 | 3.444206099 | 0.230645908 | 14.93287323 |
| ENSG00000125885 | 1015.718857 | 4.593962288 | 0.308058793 | 14.91261535 |
| ENSG00000169905 | 3146.650648 | 2.598191545 | 0.174322505 | 14.90451013 |
| ENSG00000127603 | 1566.92276 | 3.766902304 | 0.253162867 | 14.87936344 |
| ENSG00000093000 | 1377.917494 | 3.224413613 | 0.216810047 | 14.87206729 |
| ENSG00000162402 | 1308.162209 | 4.2392591 | 0.285577716 | 14.84450245 |
| ENSG00000012048 | 1174.87698 | 3.721874637 | 0.251072501 | 14.82390595 |
| ENSG00000060237 | 6163.180449 | 3.408532983 | 0.230063182 | 14.81563872 |
| ENSG00000096696 | 34158.48729 | 2.876120259 | 0.194288842 | 14.80332182 |
| ENSG00000136813 | 3307.748487 | 2.573193229 | 0.173891746 | 14.79767316 |
| ENSG00000162896 | 317.3382823 | −3.823574549 | 0.258714465 | −14.77912938 |
| ENSG00000005810 | 2665.372594 | 3.954134022 | 0.267789739 | 14.76581606 |
| ENSG00000109920 | 2102.80919 | 3.032794199 | 0.205796159 | 14.73688435 |
| ENSG00000173889 | 3568.465607 | 3.328972218 | 0.226034049 | 14.72774667 |
| ENSG00000091409 | 1376.736921 | 3.277167354 | 0.222548824 | 14.72561073 |
| ENSG00000090905 | 1748.496677 | 3.564967293 | 0.242329301 | 14.71125149 |
| ENSG00000075151 | 1852.539538 | 2.977592847 | 0.202506966 | 14.70365644 |
| ENSG00000087470 | 2643.651037 | 2.742647235 | 0.186710333 | 14.68931683 |
| ENSG00000138443 | 2514.966121 | 2.865786352 | 0.19543552 | 14.66359008 |
| ENSG00000095951 | 1596.683553 | 4.150001917 | 0.283170723 | 14.65547663 |
| ENSG00000185442 | 3097.435778 | −2.331323697 | 0.159155133 | −14.64812135 |
| ENSG00000138180 | 1506.83406 | 3.325721328 | 0.227051669 | 14.64742075 |
| ENSG00000066739 | 1655.300757 | 3.714166352 | 0.253571459 | 14.64741486 |
| ENSG00000134313 | 1290.786744 | 3.942029433 | 0.26932908 | 14.63647902 |
| ENSG00000132780 | 2389.144028 | 2.704924177 | 0.184822854 | 14.63522569 |
| ENSG00000070159 | 1973.147656 | 2.870937558 | 0.196169871 | 14.63495662 |
| ENSG00000176046 | 8805.996964 | −2.244742181 | 0.153469573 | −14.62662687 |
| ENSG00000165795 | 2045.688748 | −2.561552025 | 0.175801444 | −14.57071098 |
| ENSG00000198740 | 1607.616816 | 2.979630075 | 0.204527144 | 14.56838449 |
| ENSG00000113810 | 5372.34608 | 2.58440878 | 0.177404211 | 14.56791116 |
| ENSG00000123200 | 1756.700802 | 3.209193295 | 0.220419502 | 14.55947981 |
| ENSG00000187079 | 1153.386024 | 4.404276001 | 0.302769743 | 14.54661868 |
| ENSG00000088325 | 4982.823172 | 2.430998403 | 0.167148658 | 14.54393014 |
| ENSG00000084093 | 1797.050422 | 3.252233092 | 0.223689207 | 14.53907025 |
| ENSG00000112297 | 3110.319063 | 2.790162615 | 0.191927654 | 14.53757475 |
| ENSG00000095739 | 10166.97142 | −2.356580132 | 0.162172919 | −14.53128023 |
| ENSG00000245532 | 32538.34592 | 2.431206363 | 0.167358301 | 14.52695413 |
| ENSG00000108021 | 3451.53416 | 2.903310346 | 0.199878894 | 14.52534726 |
| ENSG00000011454 | 4170.275272 | 2.615042935 | 0.180075816 | 14.52189972 |
| ENSG00000051825 | 1115.926143 | 4.014916251 | 0.27703734 | 14.4923289 |
| ENSG00000021776 | 1521.948175 | 3.594006303 | 0.248239143 | 14.47799995 |

TABLE 6-continued

| | | | | |
|---|---|---|---|---|
| ENSG00000136731 | 3824.229305 | 2.794586823 | 0.193400393 | 14.44974739 |
| ENSG00000132466 | 3180.084236 | 3.161381787 | 0.218828205 | 14.44686617 |
| ENSG00000109610 | 8774.056284 | −2.658909985 | 0.184285734 | −14.42819214 |
| ENSG00000135480 | 10576.38995 | −2.269122766 | 0.157323047 | −14.42333342 |
| ENSG00000198901 | 3178.27828 | 2.721655494 | 0.188780136 | 14.41706502 |
| ENSG00000183018 | 2480.940108 | −2.429316374 | 0.168776737 | −14.39366833 |
| ENSG00000132849 | 3029.008192 | 3.01426983 | 0.209622825 | 14.37949243 |
| ENSG00000067369 | 2708.644275 | 3.150918987 | 0.219337666 | 14.36560829 |
| ENSG00000184445 | 2590.109728 | 2.91944578 | 0.203465799 | 14.34858239 |
| ENSG00000148143 | 1696.965981 | 3.322668409 | 0.231589526 | 14.34723095 |
| ENSG00000205268 | 2028.040751 | 2.774898765 | 0.19364236 | 14.33001935 |
| ENSG00000100888 | 2039.818581 | 2.867354826 | 0.20021676 | 14.32125272 |
| ENSG00000263244 | 1328.215715 | 3.090386874 | 0.21613132 | 14.2986536 |
| ENSG00000153107 | 984.1159243 | 3.953975026 | 0.276664221 | 14.29160234 |
| ENSG00000197312 | 1651.410227 | 3.342237131 | 0.23402355 | 14.28162737 |
| ENSG00000171345 | 86796.90523 | −2.24338859 | 0.157158375 | −14.27469957 |
| ENSG00000198604 | 1851.684856 | 2.732100048 | 0.191571165 | 14.2615411 |
| ENSG00000102893 | 1509.360437 | 3.019425074 | 0.211763222 | 14.2584961 |
| ENSG00000068878 | 3586.2619 | 2.706520077 | 0.189960725 | 14.24778771 |
| ENSG00000163625 | 1490.773345 | 4.161237375 | 0.292121125 | 14.24490399 |
| ENSG00000114030 | 2141.984658 | 2.627446136 | 0.184682287 | 14.22684424 |
| ENSG00000198879 | 1256.127789 | 3.51834382 | 0.247308753 | 14.22652363 |
| ENSG00000133401 | 2507.80992 | 3.551702773 | 0.249711953 | 14.22319889 |
| ENSG00000099812 | 2337.016166 | −2.701787871 | 0.190314282 | −14.19645355 |
| ENSG00000101474 | 10490.89027 | −2.241013487 | 0.157922188 | −14.19061831 |
| ENSG00000163960 | 2751.07858 | 3.066147542 | 0.216128542 | 14.18668496 |
| ENSG00000138182 | 1507.58205 | 3.390183223 | 0.239362587 | 14.16337976 |
| ENSG00000095787 | 3383.545967 | 2.467808496 | 0.174312216 | 14.15740421 |
| ENSG00000118200 | 2153.716561 | 3.004510658 | 0.212283424 | 14.15329849 |
| ENSG00000114573 | 2833.868858 | 2.476041207 | 0.174958761 | 14.15214188 |
| ENSG00000139218 | 3006.11861 | 3.123749052 | 0.220776521 | 14.14891871 |
| ENSG00000135164 | 1939.167778 | 2.935717056 | 0.207524787 | 14.14634412 |
| ENSG00000144554 | 1348.963072 | 2.97820845 | 0.210610001 | 14.14086908 |
| ENSG00000166145 | 21506.16738 | −2.1450886 | 0.151750137 | 44.13566169 |
| ENSG00000144485 | 1512.212261 | −2.465397643 | 0.174489654 | −14.129191 |
| ENSG00000159658 | 3136.448362 | 2.684411647 | 0.190014048 | 14.12743778 |
| ENSG00000189079 | 1675.723027 | 3.39867501 | 0.240786381 | 14.11489718 |
| ENSG00000144452 | 7365.7239 | 2.922450899 | 0.207797695 | 14.06392357 |
| ENSG00000257002 | 554.5472743 | −2.984298212 | 0.212237279 | −14.06114059 |
| ENSG00000060339 | 2850.056357 | 2.460158863 | 0.175071838 | 14.05228217 |
| ENSG00000152926 | 1512.077831 | 3.710093562 | 0.264042172 | 14.05114015 |
| ENSG00000035928 | 1398.89681 | 2.918547502 | 0.207918505 | 14.03697812 |
| ENSG00000137713 | 1165.597303 | 3.118851044 | 0.222424898 | 14.02204102 |
| ENSG00000170421 | 80546.92206 | −2.303826865 | 0.164342336 | −14.01846245 |
| ENSG00000116977 | 2086.851467 | 2.723379395 | 0.194398904 | 14.00923225 |
| ENSG00000166747 | 4837.370852 | 2.590966919 | 0.185064741 | 14.00032719 |
| ENSG00000004534 | 2998.325831 | 2.450647496 | 0.175154553 | 13.99134338 |
| ENSG00000112159 | 1815.653983 | 3.65292135 | 0.261294741 | 13.98007986 |
| ENSG00000143190 | 1047.92243 | 3.9221626 | 0.280613965 | 13.97707561 |
| ENSG00000170871 | 1662.128325 | 3.325699562 | 0.238236431 | 13.95965995 |
| ENSG00000120875 | 1396.246778 | 3.212519083 | 0.230207336 | 13.9548945 |
| ENSG00000156453 | 6586.375856 | −2.145779568 | 0.154010768 | −13.93265934 |
| ENSG00000099204 | 2261.959677 | 2.960663742 | 0.212530528 | 13.93053401 |
| ENSG00000143578 | 13450.87597 | −2.08500752 | 0.149741217 | −13.92407219 |
| ENSG00000173166 | 1696.909987 | 3.403027764 | 0.244759133 | 13.90357825 |
| ENSG00000111371 | 7982.48551 | 2.522712432 | 0.181515576 | 13.89804934 |
| ENSG00000153113 | 2919.29724 | 2.515685129 | 0.181020732 | 13.89722104 |
| ENSG00000198087 | 2181.655747 | 2.618728433 | 0.188674519 | 13.87960834 |
| ENSG00000096746 | 3410.117715 | 2.425810265 | 0.174835456 | 13.87481873 |
| ENSG00000185219 | 1424.321369 | 3.280052945 | 0.236532795 | 13.86722273 |
| ENSG00000145675 | 1509.697675 | 2.945006229 | 0.212474203 | 13.86053547 |
| ENSG00000197956 | 35488.02882 | −2.581564608 | 0.186345454 | −13.85364955 |
| ENSG00000145198 | 972.1222224 | −2.603126788 | 0.1879506 | −13.85005841 |
| ENSG00000177119 | 1795.285683 | 3.015424771 | 0.217734875 | 13.84906656 |
| ENSG00000260032 | 13852.4093 | 2.242734389 | 0.162004493 | 13.84365552 |
| ENSG00000197594 | 1357.016404 | 3.196762353 | 0.231550166 | 13.80591689 |
| ENSG00000113569 | 2491.915354 | 2.72603583 | 0.197666783 | 13.79106689 |
| ENSG00000184564 | 949.6606908 | 4.730988114 | 0.343094053 | 13.78918718 |
| ENSG00000116005 | 1619.547015 | 2.685825842 | 0.194964693 | 13.77596014 |
| ENSG00000090013 | 4570.55234 | −2.44303142 | 0.177428188 | −13.76912793 |
| ENSG00000091436 | 884.5491307 | 3.601115071 | 0.261549096 | 13.76840953 |
| ENSG00000134909 | 6103.869628 | 3.006761599 | 0.218444835 | 13.76439778 |
| ENSG00000187837 | 1981.478435 | −2.609665483 | 0.189846773 | −13.74616718 |
| ENSG00000174197 | 1289.506564 | 4.290780876 | 0.312250838 | 13.7414551 |
| ENSG00000126458 | 2311.396501 | −2.432823773 | 0.177135572 | −13.73424742 |
| ENSG00000198265 | 1639.089903 | 3.662546319 | 0.266709677 | 13.73233384 |
| ENSG00000102038 | 4163.881956 | 2.307822886 | 0.168430775 | 13.70190739 |
| ENSG00000085224 | 2030.224709 | 3.596533204 | 0.26250189 | 13.70098021 |
| ENSG00000135837 | 2202.748142 | 3.507080566 | 0.256235762 | 13.68692857 |
| ENSG00000173575 | 2453.912783 | 3.070872992 | 0.224742805 | 13.66394349 |

TABLE 6-continued

| | | | | |
|---|---|---|---|---|
| ENSG00000108510 | 2735.208547 | 3.275214862 | 0.239897947 | 13.65253396 |
| ENSG00000119314 | 3883.440044 | 2.527705964 | 0.185469196 | 13.62871042 |
| ENSG00000110395 | 1663.355741 | 3.199883599 | 0.234837387 | 13.62595472 |
| ENSG00000106462 | 931.0965693 | 3.450604038 | 0.253388561 | 13.6178367 |
| ENSG00000124466 | 3919.380196 | −2.328514124 | 0.171064645 | −13.61189581 |
| ENSG00000100503 | 1724.014698 | 2.842776998 | 0.208898524 | 13.6084111 |
| ENSG00000120594 | 912.9983226 | 3.726301871 | 0.273825949 | 13.60828617 |
| ENSG00000172725 | 19794.49121 | −2.168963415 | 0.159456614 | −13.60221668 |
| ENSG00000147642 | 522.0282205 | −2.97870771 | 0.219079471 | −13.59647114 |
| ENSG00000163428 | 2575.647943 | 2.763292482 | 0.203240148 | 13.59619398 |
| ENSG00000165934 | 2380.580277 | 2.436361212 | 0.179242323 | 13.59255547 |
| ENSG00000134982 | 1288.808947 | 3.906701057 | 0.287490822 | 13.58895923 |
| ENSG00000084676 | 1473.296174 | 2.970541071 | 0.218680512 | 13.5839314 |
| ENSG00000136861 | 7190.190895 | 2.460640768 | 0.181200596 | 13.57965048 |
| ENSG00000143891 | 1418.368727 | −2.338007994 | 0.172170011 | −13.57964709 |
| ENSG00000184828 | 482.8367283 | −2.905681044 | 0.2140185 | −13.57677509 |
| ENSG00000185009 | 2815.182702 | 2.460543301 | 0.18138202 | 13.56553035 |
| ENSG00000078674 | 2876.20062 | 2.827328135 | 0.208812809 | 13.54001295 |
| ENSG00000118873 | 2004.660637 | 3.029178505 | 0.223830947 | 13.53333194 |
| ENSG00000118193 | 878.1879327 | 4.375220692 | 0.323501666 | 13.52456929 |
| ENSG00000161800 | 4019.683811 | 2.309952471 | 0.171111333 | 13.49970474 |
| ENSG00000115457 | 2340.080071 | −2.652874686 | 0.196562504 | −13.49634155 |
| ENSG00000171298 | 5864.244371 | −2.145221496 | 0.158971935 | −13.49434093 |
| ENSG00000090686 | 1424.345473 | 2.749765747 | 0.203801894 | 13.49234637 |
| ENSG00000048707 | 3783.635338 | 3.48922731 | 0.258948517 | 13.47459855 |
| ENSG00000092148 | 4863.955553 | 2.686385655 | 0.199389878 | 13.47302924 |
| ENSG00000118058 | 3870.313509 | 3.509713594 | 0.260630301 | 13.46625308 |
| ENSG00000030582 | 16332.61973 | −2.306303332 | 0.171691391 | −13.432842 |
| ENSG00000103260 | 3176A49897 | −2.379773839 | 0.177211711 | −13.42898744 |
| ENSG00000163872 | 2194.702351 | 2.416519649 | 0.179984384 | 13.426274 |
| ENSG00000185621 | 1435.439579 | 3.370663146 | 0.25112607 | 13.42219525 |
| ENSG00000100697 | 1989.653868 | 3.291400266 | 0.245269406 | 13.41953045 |
| ENSG00000137807 | 1462.645717 | 2.886534199 | 0.215284587 | 13.40799284 |
| ENSG00000166881 | 2308.967054 | 2.606635302 | 0.194518945 | 13.40041866 |
| ENSG00000112964 | 2386.566494 | 2.677174607 | 0.19979677 | 13.39948893 |
| ENSG00000197070 | 8848.193155 | −2.164504815 | 0.161581005 | −13.39578752 |
| ENSG00000137812 | 1042.920616 | 4.182039501 | 0.312502262 | 13.38242954 |
| ENSG00000153147 | 2428.914432 | 2.365652835 | 0.176879277 | 13.37439226 |
| ENSG00000136193 | 5066.072322 | 2.413182354 | 0.180690748 | 13.35531776 |
| ENSG00000253352 | 6589.770739 | 2.507427217 | 0.187772787 | 13.35351762 |
| ENSG00000166073 | 1272.030694 | −2.339361702 | 0.175354858 | −13.34072936 |
| ENSG00000237515 | 939.4066185 | 3.555046023 | 0.266496006 | 13.33995985 |
| ENSG00000143819 | 9360.891528 | −2.045105108 | 0.153611838 | −13.31346028 |
| ENSG00000127920 | 1125.163775 | −2.701840431 | 0.203022051 | −13.30811315 |
| ENSG00000007516 | 1881.331328 | −2.270377112 | 0.170611717 | −13.30727545 |
| ENSG00000178567 | 2362.184808 | 2.656250997 | 0.199613295 | 13.30698441 |
| ENSG00000120868 | 1186.451832 | 3.04078886 | 0.228645158 | 13.2991614 |
| ENSG00000103994 | 2687.877935 | 2.980507309 | 0.224127343 | 13.29827621 |
| ENSG00000138119 | 7475.701611 | 2.503810085 | 0.188359218 | 13.29273987 |
| ENSG00000163214 | 716.0290569 | 4.341839928 | 0.32674368 | 13.28821395 |
| ENSG00000154783 | 2523.562601 | 2.716283781 | 0.20442242 | 13.28760211 |
| ENSG00000257671 | 2828.993001 | −2.282470466 | 0.172040055 | −13.26708755 |
| ENSG00000139547 | 1809.011418 | −2.610624741 | 0.196816736 | −13.26424165 |
| ENSG00000189143 | 27739.43932 | −2.065489598 | 0.155760159 | −13.26070547 |
| ENSG00000196458 | 1359.328615 | 3.056270113 | 0.23052723 | 13.25774016 |
| ENSG00000185043 | 3306.843136 | −2.164710942 | 0.163315729 | −13.25476089 |
| ENSG00000205302 | 1534.252841 | 2.620293634 | 0.197742868 | 13.25101465 |
| ENSG00000137486 | 2166.011889 | −2.292345986 | 0.173014757 | −13.24942465 |
| ENSG00000185499 | 35579.46558 | −2.029228174 | 0.153181439 | −13.24721965 |
| ENSG00000004838 | 1236.067269 | −2.475382627 | 0.186982795 | −13.23855825 |
| ENSG00000137177 | 1462.199475 | 2.979263082 | 0.225071478 | 13.23696415 |
| ENSG00000189180 | 1520.109351 | 2.882264355 | 0.21830739 | 13.20277959 |
| ENSG00000143514 | 1093.72676 | 3.007672199 | 0.227903654 | 13.19712144 |
| ENSG00000112249 | 1378.410745 | 3.076015528 | 0.233186497 | 13.19122491 |
| ENSG00000164961 | 1938.777001 | 2.52410091 | 0.191355308 | 13.19065008 |
| ENSG00000185728 | 3820.230747 | 2.322888905 | 0.176122605 | 13.18904468 |
| ENSG00000158636 | 1638.414019 | 3.090877279 | 0.234353625 | 13.18894591 |
| ENSG00000064313 | 1160.48091 | 2.980840415 | 0.226049658 | 13.18666189 |
| ENSG00000116991 | 1663.947024 | 2.875187224 | 0.218123957 | 13.18143711 |
| ENSG00000161813 | 2221.559709 | 2.404068066 | 0.182383164 | 13.18141444 |
| ENSG00000172057 | 4843.023631 | −2.103730828 | 0.159634675 | −13.17840768 |
| ENSG00000166106 | 2354.128396 | −2.5835418 | 0.196230663 | −13.16584149 |
| ENSG00000136937 | 1006.469231 | 3.074064762 | 0.233509224 | 13.16463951 |
| ENSG00000090889 | 813.0882716 | 3.399184768 | 0.258263427 | 13.16169623 |
| ENSG00000166004 | 1579.419337 | 3.111685104 | 0.236563424 | 13.15370336 |
| ENSG00000067836 | 2483.321098 | −2.161026295 | 0.164315691 | −13.15167333 |
| ENSG00000160551 | 3771.298433 | 3.408739907 | 0.259228271 | 13.14956853 |
| ENSG00000170442 | 701.8868135 | −3.034037592 | 0.230744676 | −13.14889531 |
| ENSG00000179295 | 6533.659566 | 2.307888837 | 0.175546404 | 13.14688759 |
| ENSG00000204054 | 2170.45941 | −2.155068027 | 0.163939496 | −13.14550843 |

TABLE 6-continued

| | | | | |
|---|---|---|---|---|
| ENSG00000144824 | 993.7876202 | 3.123529487 | 0.238604881 | 13.090803 |
| ENSG00000116984 | 1932.397753 | 2.925785327 | 0.223539732 | 13.08843534 |
| ENSG00000100596 | 10443.88073 | 2.48294155 | 0.189841516 | 13.079023 |
| ENSG00000257621 | 1460.527278 | 2.571583198 | 0.196632911 | 13.07809151 |
| ENSG00000168447 | 808.8586996 | −2.659924604 | 0.203464907 | −13.07313701 |
| ENSG00000242265 | 1393.736355 | 2.660085505 | 0.203504481 | 13.07138543 |
| ENSG00000119906 | 2144.361475 | 2.69719555 | 0.206475848 | 13.06300749 |
| ENSG00000079246 | 7574.261864 | 2.033547682 | 0.155708992 | 13.05992451 |
| ENSG00000132424 | 3172.55744 | 2.469764758 | 0.189140496 | 13.05783164 |
| ENSG00000149308 | 931.145287 | 3.564434606 | 0.273077426 | 13.05283508 |
| ENSG00000120137 | 5145.171716 | 2.592981127 | 0.198655669 | 13.05264098 |
| ENSG00000188559 | 1137.021628 | 3.367819245 | 0.258491766 | 13.02872928 |
| ENSG00000119285 | 2764.389007 | 2.579669257 | 0.198074253 | 13.02374847 |
| ENSG00000057019 | 1163.94905 | 2.930995109 | 0.22515351 | 13.01776331 |
| ENSG00000115226 | 446.028051 | −3.069272002 | 0.235878535 | 43.01208695 |
| ENSG00000141027 | 2122.968738 | 2.934239763 | 0.225753976 | 12.99751088 |
| ENSG00000110321 | 14405.98489 | 2.108181964 | 0.162446394 | 12.97770857 |
| ENSG00000230551 | 1294.977183 | 3.278176402 | 0.252726578 | 12.97123726 |
| ENSG00000010278 | 6355.337071 | −2.014588201 | 0.155739941 | −12.93559112 |
| ENSG00000140396 | 1980.293569 | 3.290896525 | 0.254479415 | 12.93187711 |
| ENSG00000115825 | 1208.423786 | 2.959045574 | 0.228860634 | 12.9294651 |
| ENSG00000171681 | 1027.996453 | 3.998312057 | 0.309302977 | 12.92684634 |
| ENSG00000115808 | 1063.429723 | 3.481340652 | 0.269330122 | 12.92592385 |
| ENSG00000108840 | 4465.420209 | −2.005549043 | 0.15524899 | −12.91827432 |
| ENSG00000005889 | 1167.76301 | 2.922182451 | 0.226276367 | 12.91421853 |
| ENSG00000137628 | 760.7550098 | 4.649371083 | 0.360117699 | 12.91069865 |
| ENSG00000127914 | 1759.501937 | 3.38749079 | 0.262476943 | 12.90586042 |
| ENSG00000168214 | 1155.321507 | 2.959255306 | 0.229526962 | 12.89284397 |
| ENSG00000171552 | 11355.51486 | −1.961218451 | 0.152181246 | −12.8873859 |
| ENSG00000198826 | 1438.686457 | 3.019505286 | 0.234327887 | 12.8858128 |
| ENSG00000188994 | 1056.470338 | 3.739324968 | 0.290190302 | 12.88576821 |
| ENSG00000138778 | 1040.252462 | 3.429504794 | 0.266198744 | 12.88324935 |
| ENSG00000100731 | 1442.035711 | 2.883594449 | 0.224215681 | 12.86080633 |
| ENSG00000136824 | 2852.815374 | 2.35424555 | 0.183072258 | 12.85965212 |
| ENSG00000104067 | 1270.901391 | 3.096679453 | 0.240948326 | 12.85204801 |
| ENSG00000103653 | 1452.733196 | −2.669353874 | 0.20771654 | −12.85094521 |
| ENSG00000254531 | 344.481983 | −3.24925 | 0.253152669 | −12.83514023 |
| ENSG00000204217 | 2085.659529 | 3.082426297 | 0.240188778 | 12.8333485 |
| ENSG00000066279 | 2117.156495 | 3.602077068 | 0.280727527 | 12.83122147 |
| ENSG00000177666 | 6106.648302 | −2.067860644 | 0.161165448 | 42.83066979 |
| ENSG00000163660 | 2196.052243 | 2.400603504 | 0.187333032 | 12.81463007 |
| ENSG00000118985 | 2251.694158 | 2.594683328 | 0.202479407 | 12.81455414 |
| ENSG00000184575 | 6897.632968 | 2.00798286 | 0.156776092 | 12.80796602 |
| ENSG00000175356 | 3506.516511 | −2.596776308 | 0.202823665 | −12.80312289 |
| ENSG00000123684 | 1825.208404 | 2.488937699 | 0.194435739 | 12.80082414 |
| ENSG00000115159 | 1372.569987 | 2.702050737 | 0.211097447 | 12.8000162 |
| ENSG00000142166 | 2006.943511 | 2.316398181 | 0.181104954 | 12.79036345 |
| ENSG00000143878 | 8813.508995 | −1.929828071 | 0.150991173 | −12.78106549 |
| ENSG00000152601 | 2811.200168 | 2.456094404 | 0.192211071 | 12.77811103 |
| ENSG00000159086 | 1215.537303 | 2.82000468 | 0.220703276 | 12.77735757 |
| ENSG00000163939 | 1576.667585 | 3.242177685 | 0.253793849 | 12.77484737 |
| ENSG00000137776 | 2077.371148 | 2.373242584 | 0.185819553 | 12.77175918 |
| ENSG00000136918 | 276.9169791 | −3.370642479 | 0.264093759 | −12.76305236 |
| ENSG00000145022 | 2056.249689 | −2.132603369 | 0.16717874 | −12.75642689 |
| ENSG00000113649 | 2402.756223 | 2.240866093 | 0.175711956 | 12.75306554 |
| ENSG00000103540 | 1335.273921 | 3.089315144 | 0.242308645 | 12.74950445 |
| ENSG00000116260 | 14115.96964 | −2.17692679 | 0.170753185 | −12.74896744 |
| ENSG00000100815 | 2899.449979 | 2.649082029 | 0.207952322 | 12.73889129 |
| ENSG00000107771 | 1147.213787 | 3.002805533 | 0.235859114 | 12.73135253 |
| ENSG00000009413 | 1067.150829 | 4.046619791 | 0.317898243 | 12.72929272 |
| ENSG00000197879 | 15087.21896 | −1.970202052 | 0.15483262 | −12.72472206 |
| ENSG00000074054 | 804.4076444 | 3.511807186 | 0.276414609 | 12.70485376 |
| ENSG00000184009 | 75131.89147 | −2.099465116 | 0.165251272 | −12.70468357 |
| ENSG00000169026 | 1602.386421 | −2.237283651 | 0.176215714 | −12.69627776 |
| ENSG00000135870 | 1045.402017 | 2.924762998 | 0.230528088 | 12.68723055 |
| ENSG00000101040 | 3006.025542 | 2.439552611 | 0.192336267 | 12.68378888 |
| ENSG00000117114 | 2354.827509 | 2.972226213 | 0.234429735 | 12.6785259 |
| ENSG00000198040 | 2078.168295 | 2.5028697 | 0.1974229 | 12.67770711 |
| ENSG00000147050 | 2209.03441 | 2.6214913 | 0.20682159 | 12.6751337 |
| ENSG00000102531 | 1004.723468 | 3.188620294 | 0.251938977 | 12.65631991 |
| ENSG00000072364 | 4724.14621 | 2.940570037 | 0.232403633 | 12.65285741 |
| ENSG00000124664 | 15871.44427 | −2.018922883 | 0.159664866 | −12.64475354 |
| ENSG00000180573 | 2067.83785 | −2.073997766 | 0.16404982 | −12.64248731 |
| ENSG00000147133 | 1333.97265 | 3.074488633 | 0.243681357 | 12.61683977 |
| ENSG00000076382 | 1926.581124 | 2.372929951 | 0.188090243 | 12.61591197 |
| ENSG00000146938 | 967.0529075 | 2.91668715 | 0.231261304 | 12.6120847 |
| ENSG00000235027 | 2023.052664 | −2.16606258 | 0.171753064 | −12.61149312 |
| ENSG00000169155 | 737.9782575 | 3.389609883 | 0.268803103 | 12.61001022 |
| ENSG00000188833 | 294.3575703 | −3.14579537 | 0.249567567 | −12.60498475 |
| ENSG00000116704 | 870.6560007 | 3.114359137 | 0.247156009 | 12.60078261 |

TABLE 6-continued

| | | | | |
|---|---|---|---|---|
| ENSG00000104805 | 7753.691467 | −2.079249177 | 0.165110297 | −12.59309213 |
| ENSG00000029363 | 4659.372031 | 2.27231276 | 0.180505422 | 12.5886122 |
| ENSG00000139116 | 1186.829629 | 2.819564319 | 0.224028321 | 12.58574945 |
| ENSG00000070759 | 1536.304321 | −2.145397219 | 0.170529624 | −12.58078898 |
| ENSG00000132680 | 2909.295349 | 2.156955995 | 0.171453908 | 12.58038393 |
| ENSG00000038219 | 1637.586066 | 3.22566319 | 0.256615384 | 12.57003045 |
| ENSG00000092439 | 1342.247777 | 2.939905177 | 0.234031978 | 12.56198062 |
| ENSG00000152894 | 1948.096605 | 2.529022216 | 0.201370433 | 12.55905435 |
| ENSG00000143401 | 2337.652058 | 2.198869538 | 0.175126613 | 12.55588454 |
| ENSG00000114331 | 3352.095511 | 2.386561757 | 0.190162363 | 12.55012675 |
| ENSG00000096063 | 1466.963427 | 2.487242649 | 0.19826469 | 12.54506109 |
| ENSG00000165215 | 11382.62675 | −2.076750355 | 0.165560613 | −12.54374648 |
| ENSG00000165417 | 2434.410665 | 2.272476354 | 0.181190467 | 12.54192008 |
| ENSG00000171467 | 960.2411016 | 3.140962666 | 0.250485866 | 12.53948063 |
| ENSG00000124155 | 7158.5313 | −1.94092487 | 0.154792192 | −12.53890681 |
| ENSG00000138185 | 1161.254735 | 2.824140761 | 0.22538187 | 12.53047003 |
| ENSG00000163346 | 10410.43964 | −1.904336643 | 0.151989191 | −12.52942158 |
| ENSG00000163762 | 1264.205969 | 3.495441766 | 0.279155412 | 12.52149025 |
| ENSG00000102710 | 1186.302841 | 2.725913073 | 0.217699614 | 12.52144194 |
| ENSG00000074370 | 4285.435149 | −2.174517293 | 0.173789324 | −12.51237554 |
| ENSG00000176542 | 960.9148495 | 3.652772315 | 0.291941221 | 12.51201288 |
| ENSG00000065054 | 5150.217006 | −2.078041633 | 0.166091368 | −12.51143668 |
| ENSG00000167658 | 61822.86772 | −1.928184448 | 0.154129789 | −12.5101349 |
| ENSG00000152223 | 986.9937475 | 3.478183662 | 0.278255658 | 12.49995665 |
| ENSG00000102780 | 885.6034551 | 4.122530713 | 0.329901834 | 12.49623461 |
| ENSG00000150281 | 724.9472988 | −2.421538427 | 0.193907498 | −12.48811135 |
| ENSG00000119684 | 903.2095171 | 2.981639925 | 0.238841618 | 12.48375369 |
| ENSG00000088002 | 1350.444212 | −2.259793432 | 0.181115184 | −12.47710648 |
| ENSG00000139354 | 847.8215522 | 3.696590171 | 0.296404873 | 12.47142172 |
| ENSG00000203668 | 1484.441175 | 2.687032143 | 0.215535595 | 12.46676745 |
| ENSG00000109046 | 3072.774147 | 2.154337799 | 0.172891136 | 12.46066078 |
| ENSG00000133657 | 5523.521858 | 2.562974442 | 0.205870216 | 12.44946692 |
| ENSG00000065328 | 893.9753968 | 6.561040873 | 0.527390448 | 12.44057584 |
| ENSG00000261609 | 794.8735464 | 3.360673803 | 0.270181805 | 12.43856448 |
| ENSG00000100994 | 6024.120141 | −2.003437004 | 0.161069878 | −12.4383096 |
| ENSG00000179403 | 6432.007563 | −2.182496102 | 0.175474085 | −12.4377118 |
| ENSG00000249437 | 757.048497 | 3.343071023 | 0.269014438 | 12.42710631 |
| ENSG00000137804 | 2887.720387 | 2.201430602 | 0.17729904 | 12.41648349 |
| ENSG00000101596 | 1004.728834 | 3.186637779 | 0.256916761 | 12.40338609 |
| ENSG00000225830 | 889.6485744 | 3.494003433 | 0.281717445 | 12.40251002 |
| ENSG00000012983 | 1326.893562 | 2.650535124 | 0.213747531 | 12.40030756 |
| ENSG00000155366 | 6134.61034 | −2.115593155 | 0.170741106 | −12.39064925 |
| ENSG00000077097 | 4499A12085 | 2.072889566 | 0.167338761 | 12.38738444 |
| ENSG00000106692 | 1480.592662 | 2.849367077 | 0.230240676 | 12.37560247 |
| ENSG00000117984 | 11079.4576 | −2.130203264 | 0.172208718 | −12.3698921 |
| ENSG00000137710 | 2857.180859 | 2.292899213 | 0.185452859 | 12.36378468 |
| ENSG00000143761 | 24190.94611 | −1.884139751 | 0.152457917 | −12.3584251 |
| ENSG00000198355 | 2235.988491 | −2.077104376 | 0.168078595 | −12.35793515 |
| ENSG00000111300 | 1119.167307 | 2.708916787 | 0.219249076 | 12.35543081 |
| ENSG00000215301 | 8731.777179 | 2.021762319 | 0.16367413 | 12.35236334 |
| ENSG00000215845 | 4078.476767 | −1.949443613 | 0.157875051 | −12.34801573 |
| ENSG00000048028 | 971.1774604 | 2.815901618 | 0.228087103 | 12.34572925 |
| ENSG00000110092 | 6060.396362 | 2.048863238 | 0.165994356 | 12.34296932 |
| ENSG00000186577 | 1031.404917 | −2.484405281 | 0.201296739 | −12.34200458 |
| ENSG00000124243 | 1516.40151 | −2.167471743 | 0.175619735 | −12.34184613 |
| ENSG00000117139 | 5473.759574 | 2.275594036 | 0.184410113 | 12.33985487 |
| ENSG00000162004 | 991.6592703 | −2.302330483 | 0.186594635 | −12.33867462 |
| ENSG00000111961 | 1470.952899 | 3.15164215 | 0.25543765 | 12.33820525 |
| ENSG00000169855 | 1683.008097 | 2.887109656 | 0.234144178 | 12.3304781 |
| ENSG00000183888 | 461.470973 | −2.808406567 | 0.227964022 | −12.31951664 |
| ENSG00000264558 | 932.3348741 | 2.831286375 | 0.229914565 | 12.31451505 |
| ENSG00000124795 | 5645.732542 | 1.992405788 | 0.161800055 | 12.31399942 |
| ENSG00000166557 | 11531.00425 | −1.879264428 | 0.152623066 | −12.31310883 |
| ENSG00000129654 | 1806.245502 | −2.736464974 | 0.222272357 | −12.31131486 |
| ENSG00000140525 | 2655.432517 | 2.385690386 | 0.193792916 | 12.31051387 |
| ENSG00000123473 | 699.9924974 | 3.488235674 | 0.283400157 | 12.30851709 |
| ENSG00000108786 | 1926.212774 | −2.037502015 | 0.165555492 | −12.30706391 |
| ENSG00000141522 | 10630.7017 | −2.002847116 | 0.162766864 | −12.30500522 |
| ENSG00000125686 | 2152.777757 | 3.148385353 | 0.255907318 | 12.30283439 |
| ENSG00000100201 | 13498.78188 | 2.399063766 | 0.195314419 | 12.28308579 |
| ENSG00000185624 | 55775.57613 | −1.896926039 | 0.154454964 | −12.28141842 |
| ENSG00000120327 | 614.3404531 | 3.824183958 | 0.311393062 | 12.28089004 |
| ENSG00000175137 | 3118.73293 | −1.952923672 | 0.159030536 | −12.28018039 |
| ENSG00000124789 | 2151.824951 | 2.368469652 | 0.192920075 | 12.27694757 |
| ENSG00000197746 | 29839.48897 | −1.906014413 | 0.15528121 | −12.27459791 |
| ENSG00000169692 | 2027.865432 | −2.419645384 | 0.197201215 | −12.26993145 |
| ENSG00000141736 | 22095.4273 | −1.833867291 | 0.149504866 | −12.26627161 |
| ENSG00000167797 | 4493.34318 | −2.090225849 | 0.170412534 | −12.26568138 |
| ENSG00000164151 | 1494.524692 | 2.795596959 | 0.227945777 | 12.26430685 |
| ENSG00000178814 | 2555.412696 | −2.138643419 | 0.174423895 | −12.26118372 |

TABLE 6-continued

| | | | | |
|---|---|---|---|---|
| ENSG00000174080 | 5352.052495 | −2.005229933 | 0.163559154 | −12.25996766 |
| ENSG00000166828 | 191.272256 | −3.647810746 | 0.297668087 | −12.25462486 |
| ENSG00000156970 | 876.6312178 | 3.286600244 | 0.268275156 | 12.2508558 |
| ENSG00000100485 | 1395.94959 | 2.631333807 | 0.214829502 | 12.24847511 |
| ENSG00000130779 | 2604.085066 | 2.598163127 | 0.212234224 | 12.24196119 |
| ENSG00000171302 | 14686.38097 | −1.819964721 | 0.148824952 | −12.22889509 |
| ENSG00000076003 | 1671.861322 | 2.306011131 | 0.188580876 | 12.2282343 |
| ENSG00000164134 | 1200.997099 | 2.51254782 | 0.205471656 | 12.22819668 |
| ENSG00000213186 | 2220.175559 | 2.209674542 | 0.180880027 | 12.21624396 |
| ENSG00000196247 | 887.3014419 | 3.218928095 | 0.263498382 | 12.21612092 |
| ENSG00000138496 | 2401.033512 | 2.318976882 | 0.189915208 | 12.21059075 |
| ENSG00000107521 | 2901.014346 | −1.958504168 | 0.16039951 | −12.21016307 |
| ENSG00000198369 | 1445.92836 | 2.586898854 | 0.211894953 | 12.2084024 |
| ENSG00000157741 | 965.0421715 | 3.732514502 | 0.306050497 | 12.19574724 |
| ENSG00000111670 | 1965.641657 | 2.528771036 | 0.207418958 | 12.19160995 |
| ENSG00000116285 | 1377.631838 | 2.408145809 | 0.197694874 | 12.1811242 |
| ENSG00000233622 | 328.6461109 | −2.907796362 | 0.238721705 | −12.18069534 |
| ENSG00000178057 | 1883.623289 | −2.12273605 | 0.174275382 | −12.18035515 |
| ENSG00000186660 | 3389.944901 | 2.030135242 | 0.166751074 | 12.17464566 |
| ENSG00000061987 | 3591.024758 | 2.607744499 | 0.214453262 | 12.15996657 |
| ENSG00000225138 | 722.4251073 | −2.371977246 | 0.195072412 | −12.15947051 |
| ENSG00000198146 | 1392.300798 | 2.627075996 | 0.216099263 | 12.1568022 |
| ENSG00000153250 | 1099.989696 | 2.755098876 | 0.226647456 | 12.15587821 |
| ENSG00000105518 | 2912.642097 | −2.133713774 | 0.175529681 | −12.15585742 |
| ENSG00000197982 | 3743.89411 | −2.249040787 | 0.185124282 | 42.1488517 |
| ENSG00000169398 | 3212.205943 | 2.054861648 | 0.169275087 | 12.13918528 |
| ENSG00000174373 | 1669.446376 | 3.060481625 | 0.25214129 | 12.13796289 |
| ENSG00000135929 | 305.3428282 | −3.128995485 | 0.257877616 | −12.13364514 |
| ENSG00000123983 | 3511.840841 | 1.998514857 | 0.164720927 | 12.13273197 |
| ENSG00000135821 | 8714.323807 | −1.969053025 | 0.162416588 | −12.12347245 |
| ENSG00000105289 | 3643.091425 | −1.896008276 | 0.156498382 | −12.11519409 |
| ENSG00000108506 | 816.6189173 | 3.229054307 | 0.26685049 | 12.10061226 |
| ENSG00000149809 | 20691.16838 | −2.074854543 | 0.17152671 | −12.09639329 |
| ENSG00000266962 | 1543.756702 | −2.084794021 | 0.172394477 | −12.09316018 |
| ENSG00000130193 | 4856.374341 | −2.010174308 | 0.166235936 | −12.09229698 |
| ENSG00000168411 | 2104.034555 | 2.232549452 | 0.184675847 | 12.089017 |
| ENSG00000198730 | 1816.948329 | 2.212088165 | 0.183086115 | 12.08222789 |
| ENSG00000151090 | 1093.877557 | 3.185744938 | 0.263755574 | 12.07839855 |
| ENSG00000083168 | 3178.648478 | 2.921549707 | 0.241915949 | 12.07671392 |
| ENSG00000257181 | 819.9981348 | 2.985877755 | 0.247284249 | 12.0746783 |
| ENSG00000135272 | 1063.169094 | 2.668339349 | 0.221080854 | 12.06951802 |
| ENSG00000157625 | 1687.465485 | 2.738792711 | 0.226986168 | 12.06590134 |
| ENSG00000196963 | 821.0998686 | 3.192146578 | 0.264649014 | 12.06181173 |
| ENSG00000245156 | 4773.51693 | −1.864008676 | 0.154538897 | −12.06174443 |
| ENSG00000171295 | 966.405697 | 2.722166107 | 0.225814509 | 12.05487689 |
| ENSG00000165140 | 3812.778559 | −2.115901138 | 0.175570231 | −12.051594 |
| ENSG00000166439 | 1124.341927 | 2.955508927 | 0.24526366 | 12.05033364 |
| ENSG00000083845 | 12971.26056 | −2.016100844 | 0.167338333 | −12.04805142 |
| ENSG00000179627 | 3831.296217 | −1.93477121 | 0.160600036 | −12.04714054 |
| ENSG00000137801 | 6759.94768 | 2.674645313 | 0.222047001 | 12.04540164 |
| ENSG00000137941 | 622.8485609 | 3.595399626 | 0.29850163 | 12.04482411 |
| ENSG00000121957 | 1702.872078 | 2.284282953 | 0.189795955 | 12.03546698 |
| ENSG00000167258 | 2415.280956 | 2.620146848 | 0.217705341 | 12.03528972 |
| ENSG00000176978 | 6469.287666 | −2.002157321 | 0.166377586 | −12.03381642 |
| ENSG00000180530 | 1400.741248 | 2.816580388 | 0.234090201 | 12.0320303 |
| ENSG00000163755 | 1059.446572 | 2.603355988 | 0.216419215 | 12.02922759 |
| ENSG00000096060 | 1588.465947 | 2.391105176 | 0.199008612 | 12.01508392 |
| ENSG00000143776 | 3026.172435 | 3.091815047 | 0.257363827 | 12.01340174 |
| ENSG00000130529 | 3727.655353 | −1.937850678 | 0.161347756 | −12.01039744 |
| ENSG00000135341 | 1297.954294 | 2.400588973 | 0.200046057 | 12.00018139 |
| ENSG00000163961 | 1634.218658 | 2.240403767 | 0.18672272 | 11.99856003 |
| ENSG00000173905 | 960.6284583 | 2.658879174 | 0.221765347 | 11.98960616 |
| ENSG00000261183 | 970.9013977 | −2.183033434 | 0.182123565 | −11.9865512 |
| ENSG00000125633 | 1482.967755 | 2.631404131 | 0.219733917 | 11.97541176 |
| ENSG00000204308 | 1917.344131 | −2.072943335 | 0.173120659 | −11.97398015 |
| ENSG00000083896 | 1833.838342 | 2.236417454 | 0.186838346 | 11.96979907 |
| ENSG00000121741 | 2487.348187 | 2.31560979 | 0.193504576 | 11.96669269 |
| ENSG00000151693 | 803.3169284 | 3.182138461 | 0.266033088 | 11.96143863 |
| ENSG00000182584 | 512.4846112 | −2.532845363 | 0.21184911 | −11.95589336 |
| ENSG00000170266 | 4876.189147 | −1.893825783 | 0.158421095 | −11.95437882 |
| ENSG00000135924 | 2881.413955 | −2.06662657 | 0.172878585 | −11.95420805 |
| ENSG00000143367 | 2104.360267 | −1.982834352 | 0.165914672 | −11.95092834 |
| ENSG00000174371 | 690.367864 | 3.131521936 | 0.262036193 | 11.95072293 |
| ENSG00000125534 | 13369.42465 | −2.006115711 | 0.167912171 | −11.94741096 |
| ENSG00000011114 | 1684.849418 | 2.627963179 | 0.219966202 | 11.9471226 |
| ENSG00000149418 | 29507.11199 | −1.846785079 | 0.154619682 | −11.94404912 |
| ENSG00000046604 | 2194.426746 | 2.235671932 | 0.187215281 | 11.94171712 |
| ENSG00000106780 | 6684.112023 | 2.156670544 | 0.180683103 | 11.93620491 |
| ENSG00000168350 | 9145.47512 | −2.209328824 | 0.185117095 | −11.93476393 |
| ENSG00000106415 | 702.9196643 | 3.287249962 | 0.275572044 | 11.92882237 |

TABLE 6-continued

| | | | | |
|---|---|---|---|---|
| ENSG00000175455 | 2163.5262 | 2.812087781 | 0.235788638 | 11.92630741 |
| ENSG00000198420 | 3861.201264 | 2.370985506 | 0.198825764 | 11.92494103 |
| ENSG00000124177 | 3122.862706 | 2.861993202 | 0.240178859 | 11.91609128 |
| ENSG00000010818 | 671.883826 | 3.774831274 | 0.316798999 | 11.91554042 |
| ENSG00000149311 | 2464.008981 | 2.840737917 | 0.238417639 | 11.91496539 |
| ENSG00000172939 | 2074.450877 | 2.114792514 | 0.177511692 | 11.91353929 |
| ENSG00000197535 | 982.5008104 | 3.532376248 | 0.296623396 | 11.90862319 |
| ENSG00000114790 | 1162.960314 | 2.463370953 | 0.206867875 | 11.90794342 |
| ENSG00000055208 | 2179.358828 | 2.366373502 | 0.198863642 | 11.89947784 |
| ENSG00000167703 | 1758.210495 | −2.023602534 | 0.170075937 | −11.89822955 |
| ENSG00000122966 | 2346.947476 | 2.521131893 | 0.211904818 | 11.89747319 |
| ENSG00000137075 | 671.1574409 | 3.456119713 | 0.290726105 | 11.88788915 |
| ENSG00000079999 | 2914.753614 | −1.992533778 | 0.167619942 | −11.88721197 |
| ENSG00000198483 | 243.6471462 | −3.296227907 | 0.277376781 | −11.88357545 |
| ENSG00000104904 | 12596.91383 | −2.038590739 | 0.171556242 | −11.88292953 |
| ENSG00000171148 | 5909.219802 | −1.860393918 | 0.156583106 | −11.88119178 |
| ENSG00000129951 | 367.9388677 | −2.884993773 | 0.242871554 | −11.87868124 |
| ENSG00000198315 | 791.3068144 | 3.921840353 | 0.33024499 | 11.87554838 |
| ENSG00000073711 | 822.3278472 | 3.107679926 | 0.261817784 | 11.86962886 |
| ENSG00000146540 | 4153.032274 | −2.121274467 | 0.178801124 | −11.86387659 |
| ENSG00000040731 | 1601.1352 | 2.530448273 | 0.21331174 | 11.86267698 |
| ENSG00000138802 | 753.1177409 | 2.920631934 | 0.246226215 | 11.86157996 |
| ENSG00000120008 | 1178.942393 | 2.542912898 | 0.214409641 | 11.86006789 |
| ENSG00000262413 | 4918.64105 | −2.029615515 | 0.17114749 | −11.8588681 |
| ENSG00000107581 | 5581.52679 | 1.903856118 | 0.160550713 | 11.85828503 |
| ENSG00000114805 | 1398.887247 | 2.939338047 | 0.247884991 | 11.85766849 |
| ENSG00000162496 | 743.3712731 | −2.332483608 | 0.196733415 | −11.85606221 |
| ENSG00000079387 | 1152.393603 | 2.509238771 | 0.21175428 | 11.84976651 |
| ENSG00000185303 | 141.6413627 | −3.997355219 | 0.337351249 | −11.84923795 |
| ENSG00000100321 | 4181.745277 | −1.847799799 | 0.155972541 | −11.84695579 |
| ENSG00000134318 | 787.2517452 | 3.341112062 | 0.282325776 | 11.83424381 |
| ENSG00000115649 | 2586.343324 | −1.936812842 | 0.163663007 | −11.83415165 |
| ENSG00000147548 | 3624.786351 | 2.341638428 | 0.197923538 | 11.83102551 |
| ENSG00000151491 | 3129.630526 | 2.123245923 | 0.179535577 | 11.82632414 |
| ENSG00000113522 | 2044.822908 | 2.336231732 | 0.197572149 | 11.82470175 |
| ENSG00000157540 | 1888.658898 | 2.206552776 | 0.186617592 | 11.82392694 |
| ENSG00000002834 | 11155.93523 | −1.932418752 | 0.163520258 | −11.81761071 |
| ENSG00000133313 | 3586.070107 | −1.89659253 | 0.160534693 | −11.81422219 |
| ENSG00000134644 | 2735.034822 | 2.182867606 | 0.184909227 | 11.80507669 |
| ENSG00000206530 | 1060.561812 | 3.172373896 | 0.268900662 | 11.79756817 |
| ENSG00000134744 | 859.7194233 | 2.995206801 | 0.253945477 | 11.79468459 |
| ENSG00000130338 | 1530.647135 | 2.651738976 | 0.224838801 | 11.79399397 |
| ENSG00000085831 | 1435.639914 | −2.035913082 | 0.172624686 | −11.79386987 |
| ENSG00000179085 | 916.0692213 | −2.358702091 | 0.200009926 | −11.79292515 |
| ENSG00000074657 | 984.6266253 | 2.968649402 | 0.251773908 | 11.7909335 |
| ENSG00000172830 | 7756.539178 | −1.824133447 | 0.154706773 | −11.79090879 |
| ENSG00000168140 | 1541.483808 | −2.001875051 | 0.170101094 | −11.76873706 |
| ENSG00000118412 | 834.5116635 | 3.302184515 | 0.280617277 | 11.76757381 |
| ENSG00000122971 | 698.2337784 | −2.369744065 | 0.201392698 | −11.76678244 |
| ENSG00000011258 | 919.2697723 | 2.747297814 | 0.233506856 | 11.76538392 |
| ENSG00000196670 | 1353.337612 | 2.388004923 | 0.203068111 | 11.75962546 |
| ENSG00000133858 | 2919.375624 | 2.44558686 | 0.208006854 | 11.75724169 |
| ENSG00000196408 | 978.1704934 | −2.234032024 | 0.190144064 | −11.74915472 |
| ENSG00000128833 | 2941.840565 | 2.531623482 | 0.215585755 | 11.74299983 |
| ENSG00000123104 | 1430.938921 | 3.060657978 | 0.260669774 | 11.74151467 |
| ENSG00000051341 | 552.220288 | 4.196833456 | 0.357523816 | 11.73861227 |
| ENSG00000171241 | 547A56001 | 3.797293808 | 0.323697412 | 11.73099836 |
| ENSG00000260822 | 609.1349738 | 3.286999147 | 0.280269834 | 11.72798048 |
| ENSG00000143924 | 826.9394601 | 2.764443227 | 0.235743206 | 11.72650219 |
| ENSG00000109805 | 1145.707374 | 2.637388998 | 0.224919289 | 11.72593514 |
| ENSG00000125744 | 1086.533576 | −2.188887976 | 0.186688105 | −11.72483899 |
| ENSG00000171813 | 1130.925459 | −2.120606918 | 0.180904518 | −11.7222441 |
| ENSG00000078902 | 2326.262894 | −1.927943358 | 0.164539501 | −11.71720679 |
| ENSG00000116406 | 2444.566602 | 2.348294212 | 0.200418026 | 11.71698108 |
| ENSG00000143322 | 1101.856263 | 2.951681053 | 0.252115865 | 11.70763712 |
| ENSG00000161011 | 16783.84331 | −1.974637899 | 0.168684497 | −11.70610181 |
| ENSG00000111057 | 41206.96775 | −1.952233672 | 0.166837411 | −11.70141431 |
| ENSG00000176845 | 2237.7133 | −2.179848876 | 0.186304269 | −11.70047733 |
| ENSG00000103657 | 1888.759406 | 3.203585164 | 0.273818128 | 11.69968253 |
| ENSG00000073921 | 3441.505178 | 1.927689084 | 0.164818758 | 11.69581123 |
| ENSG00000128585 | 1038.795551 | 2.968035534 | 0.253810265 | 11.69391448 |
| ENSG00000173212 | 633.2958965 | 4.441106822 | 0.379806477 | 11.69307817 |
| ENSG00000170949 | 716.6533068 | 3.062587849 | 0.261954749 | 11.69128586 |
| ENSG00000143970 | 1100.964728 | 3.036434593 | 0.259787926 | 11.68812823 |
| ENSG00000163808 | 680.9663435 | 3.381724054 | 0.289542854 | 11.67952862 |
| ENSG00000101639 | 907.3453284 | 3.24539075 | 0.278132253 | 11.6685164 |
| ENSG00000107281 | 10841.06703 | −1.917226973 | 0.164329272 | −11.66698393 |
| ENSG00000255108 | 2295.15171 | −2.033186023 | 0.174304137 | −11.66458843 |
| ENSG00000149932 | 2658.407777 | −1.920188464 | 0.164731966 | −11.65644111 |
| ENSG00000110318 | 1080.538313 | 3.116409235 | 0.267368085 | 11.65587595 |

TABLE 6-continued

| | | | | |
|---|---|---|---|---|
| ENSG00000111145 | 602.793928 | 3.240494868 | 0.278259154 | 11.64560021 |
| ENSG00000177311 | 1868.307839 | 2.807057797 | 0.241164971 | 11.63957513 |
| ENSG00000115904 | 1074.16347 | 2.97148815 | 0.255304904 | 11.63897796 |
| ENSG00000158109 | 2690.242217 | −1.951773383 | 0.167729636 | −11.63642533 |
| ENSG00000075391 | 1010.822606 | 3.170987298 | 0.272563521 | 11.63393871 |
| ENSG00000184939 | 1013.067061 | 2.747730191 | 0.236252118 | 11.6304997 |
| ENSG00000167778 | 3213.832189 | −1.908355204 | 0.164183057 | −11.62333825 |
| ENSG00000172493 | 1297.868611 | 2.85155607 | 0.245347864 | 11.62250498 |
| ENSG00000100354 | 1287.253982 | 3.30222841 | 0.284143304 | 11.62170062 |
| ENSG00000235863 | 777.4367073 | −2.367688442 | 0.203824712 | −11.61629723 |
| ENSG00000141298 | 903.670793 | 3.028990655 | 0.260830198 | 11.61288331 |
| ENSG00000164164 | 1236.076124 | 2.439790961 | 0.210099243 | 11.61256426 |
| ENSG00000162734 | 7130.170562 | −1.850868733 | 0.159489778 | −11.6049364 |
| ENSG00000182809 | 7847.926894 | −1.913555988 | 0.164895922 | −11.60462894 |
| ENSG00000162817 | 3306.286828 | −1.954800087 | 0.168655293 | −11.59050544 |
| ENSG00000158246 | 1710.708063 | −2.003946126 | 0.172902173 | −11.59005746 |
| ENSG00000123933 | 5881.177 | −1.836445905 | 0.158496597 | −11.58665827 |
| ENSG00000146648 | 658.1992509 | 3.218301772 | 0.277810875 | 11.58450611 |
| ENSG00000172602 | 1149.311398 | −2.082541295 | 0.179918349 | −1.1.57492445 |
| ENSG00000170921 | 923.5330196 | 3.189821126 | 0.275661529 | 11.57151357 |
| ENSG00000198231 | 4331.849605 | 1.93090766 | 0.166901508 | 11.56914451 |
| ENSG00000008294 | 1676.762198 | 2.283599821 | 0.197394682 | 11.56869983 |
| ENSG00000197555 | 1680.743943 | 2.245222708 | 0.194147892 | 11.564497 |
| ENSG00000127663 | 2696.109617 | −1.86155972 | 0.160999736 | −11.5625017 |
| ENSG00000197321 | 2811.576217 | 2.343300225 | 0.202681061 | 11.56151551 |
| ENSG00000172795 | 3203.954397 | 2.211958739 | 0.191454324 | 11.55345405 |
| ENSG00000090060 | 5110.055116 | 1.849555973 | 0.16012334 | 11.55082057 |
| ENSG00000233078 | 325.886395 | −2.898825631 | 0.25101032 | −11.54863128 |
| ENSG00000107821 | 7275.970181 | −1.747920479 | 0.151459747 | −11.54049513 |
| ENSG00000174903 | 25696.31453 | −1.795968475 | 0.1556579 | −11.53792051 |
| ENSG00000196693 | 919.5585041 | 2.632904462 | 0.228247663 | 11.53529648 |
| ENSG00000139722 | 3209.577711 | −1.848818736 | 0.160311258 | −11.53268188 |
| ENSG00000109501 | 4383.82323 | −2.058684336 | 0.178557564 | −11.52952743 |
| ENSG00000169189 | 2172.134076 | −1.98840405 | 0.172462479 | −11.52948783 |
| ENSG00000094804 | 1018.564374 | 2.485864679 | 0.215685994 | 11.5253876 |
| ENSG00000156273 | 702.7028023 | 3.15261981 | 0.273593935 | 11.52298865 |
| ENSG00000135404 | 14027.9398 | −1.990404225 | 0.172771267 | −11.52045857 |
| ENSG00000119397 | 875.9392592 | 3.114138047 | 0.27042555 | 11.51569462 |
| ENSG00000269987 | 848.6747166 | 2.674171767 | 0.23222417 | 11.51547562 |
| ENSG00000196924 | 10938.60704 | −1.841401341 | 0.159993326 | −11.50923846 |
| ENSG00000174718 | 603.7284579 | 3.621819152 | 0.314757768 | 11.50668712 |
| ENSG00000166483 | 1066.480235 | 2.476396689 | 0.215363741 | 11.49867047 |
| ENSG00000070882 | 708.9781007 | 2.913217531 | 0.253363723 | 11.49816357 |
| ENSG00000068489 | 575.6849933 | 3.595992525 | 0.312769187 | 11.49727233 |
| ENSG00000119912 | 1893.124171 | 2.148490917 | 0.186888766 | 11.4960945 |
| ENSG00000107201 | 1239.282816 | 2.461733306 | 0.214169411 | 11.49432732 |
| ENSG00000272565 | 835.8207209 | 2.713874564 | 0.236141241 | 11.49259043 |
| ENSG00000268313 | 6031.74853 | 1.828059112 | 0.159096707 | 11.49023855 |
| ENSG00000153187 | 12462.41636 | 1.744368333 | 0.151856552 | 11.48694814 |
| ENSG00000126247 | 6517.294299 | −1.882645591 | 0.163956565 | −11.48258764 |
| ENSG00000136492 | 564.1090292 | 4.098185979 | 0.357000727 | 11.47948916 |
| ENSG00000121653 | 1213.937278 | −2.159217395 | 0.188103786 | −11.47886198 |
| ENSG00000143493 | 1105.479318 | 2.386257185 | 0.208088042 | 11.46753636 |
| ENSG00000197043 | 14806.31637 | −1.960741557 | 0.171016225 | −11.46523703 |
| ENSG00000166197 | 5319.264264 | 1.844955294 | 0.160955249 | 11.46253571 |
| ENSG00000153531 | 1095.961007 | −2.111757192 | 0.184264326 | −11.46047765 |
| ENSG00000198887 | 760.9019356 | 3.145569955 | 0.274528041 | 11.45810077 |
| ENSG00000181827 | 599.1520221 | 3.82137462 | 0.333544657 | 11.45686054 |
| ENSG00000162755 | 665.3922031 | −2.286052138 | 0.19960186 | −11.45306028 |
| ENSG00000271430 | 501.9479152 | 3.828635719 | 0.334317214 | 11.45210465 |
| ENSG00000126005 | 2307.632708 | −1.874417603 | 0.163736992 | −11.44773441 |
| ENSG00000085644 | 1444.342598 | −1.961547324 | 0.171508422 | −11.43703205 |
| ENSG00000033800 | 619.5219514 | 3.656081943 | 0.319935509 | 11.42755913 |
| ENSG00000110723 | 775.9724034 | 3.474460832 | 0.304141742 | 11.42382106 |
| ENSG00000166432 | 819.6054764 | 3.273090065 | 0.28660401 | 11.42025216 |
| ENSG00000126653 | 786.3572746 | 2.689614543 | 0.235533266 | 11.41925548 |
| ENSG00000065526 | 1592.807884 | 2.882563492 | 0.252454607 | 11.41814671 |
| ENSG00000099330 | 1126.911437 | −2.096872428 | 0.183702307 | −11.41451331 |
| ENSG00000104093 | 1256.14819 | 3.423041039 | 0.29993314 | 11.41268029 |
| ENSG00000179632 | 4765.559357 | −1.948146917 | 0.17080123 | −11.40593024 |
| ENSG00000005483 | 1103.241038 | 3.191554839 | 0.279846416 | 11.40466576 |
| ENSG00000140181 | 945.2605224 | 2.579888388 | 0.226405305 | 11.3949997 |
| ENSG00000139746 | 1636.314293 | 2.204318422 | 0.193451316 | 11.39469332 |
| ENSG00000161395 | 1522.627887 | −2.046698919 | 0.179879453 | −11.37816958 |
| ENSG00000196517 | 1027.586098 | −2.100409737 | 0.184637052 | −11.37588427 |
| ENSG00000075420 | 2363.575692 | 2.054607771 | 0.180611809 | 11.37582187 |
| ENSG00000150054 | 1847.740842 | 2.351349386 | 0.206755082 | 11.37263164 |
| ENSG00000137145 | 1363.722922 | 2.723862216 | 0.239531139 | 11.3716414 |
| ENSG00000185909 | 612.7232876 | −2.320798891 | 0.204115637 | −11.3700201 |
| ENSG00000181449 | 1134.005565 | −2.070423747 | 0.182270298 | −11.35908463 |

TABLE 6-continued

| | | | | |
|---|---|---|---|---|
| ENSG00000163257 | 1222.804203 | 2.360532732 | 0.207864047 | 11.35613765 |
| ENSG00000174938 | 4330.46364 | −1.848231959 | 0.162759455 | −11.35560425 |
| ENSG00000185924 | 939.2038918 | −2.11279259 | 0.18622318 | −11.34548655 |
| ENSG00000050405 | 3194.005752 | 1.952676208 | 0.17215212 | 11.3427369 |
| ENSG00000225410 | 6964.525559 | −2.006672913 | 0.176965 | −11.33937735 |
| ENSG00000182621 | 902.9041856 | 2.809155777 | 0.24778139 | 11.33723471 |
| ENSG00000123066 | 4309.910751 | 2.903080268 | 0.256171478 | 11.33256633 |
| ENSG00000163629 | 1041.009008 | 2.772129615 | 0.244833289 | 11.32251921 |
| ENSG00000023516 | 1972.508688 | 2.817492482 | 0.248989778 | 11.31569537 |
| ENSG00000143442 | 3706.584524 | 2.069201031 | 0.182896739 | 11.31349331 |
| ENSG00000176208 | 512.9122055 | 3.9673176 | 0.350753971 | 11.31082731 |
| ENSG00000118482 | 1875.020421 | 2.390188513 | 0.211389146 | 11.30705413 |
| ENSG00000107262 | 3011.397197 | −2.146326748 | 0.189993732 | −11.29682922 |
| ENSG00000120458 | 984.9284264 | 2.589080805 | 0.229451398 | 11.28378744 |
| ENSG00000159147 | 1469.214589 | 2.158818266 | 0.191386754 | 11.27987291 |
| ENSG00000142864 | 5682.353364 | 1.813464088 | 0.160779998 | 11.27916479 |
| ENSG00000244187 | 2084.225888 | −2.089191598 | 0.185266839 | −11.27666241 |
| ENSG00000121900 | 2862.581658 | −2.027132111 | 0.17981172 | −11.27363728 |
| ENSG00000165209 | 1377.547377 | 2.259936637 | 0.200663338 | 11.26232951 |
| ENSG00000082701 | 2680.104078 | 2.211213092 | 0.196542105 | 11.25058213 |
| ENSG00000117362 | 11452.40466 | −1.789089713 | 0.159060175 | −11.24787969 |
| ENSG00000196323 | 2455.774447 | 2.260890919 | 0.201039256 | 11.24601714 |
| ENSG00000164307 | 1794.095379 | 2.07128407 | 0.184185564 | 11.24563743 |
| ENSG00000204389 | 3064.268457 | −1.943962482 | 0.172865253 | −11.24553632 |
| ENSG00000177628 | 5956.706806 | −1.717076306 | 0.152728235 | −11.24269071 |
| ENSG00000140264 | 20467.82196 | −1.697316026 | 0.150971861 | −11.24259852 |
| ENSG00000080200 | 716.527711 | 2.844160852 | 0.253027742 | 11.24050993 |
| ENSG00000167741 | 6425.431867 | −1.758657471 | 0.156481724 | −11.23874035 |
| ENSG00000169118 | 1126.55439 | 2.599107108 | 0.231286097 | 11.23762793 |
| ENSG00000168137 | 5202.691025 | 2.157163793 | 0.191978518 | 11.2364853 |
| ENSG00000166024 | 527.1073318 | 3.391516537 | 0.301912214 | 11.23345256 |
| ENSG00000132300 | 1196.544833 | 2.267705884 | 0.201974369 | 11.2276914 |
| ENSG00000023191 | 5808.219108 | −1.949937161 | 0.173737354 | −11.22347676 |
| ENSG00000048828 | 3984.056471 | 1.845804652 | 0.164460426 | 11.22339698 |
| ENSG00000154760 | 704.3815276 | 3.080364612 | 0.274561024 | 11.21923488 |
| ENSG00000177200 | 1199.333643 | 3.259476857 | 0.290558697 | 11.21796351 |
| ENSG00000183354 | 676.4965435 | 3.852246105 | 0.343611042 | 11.21106601 |
| ENSG00000165891 | 774.6629392 | 3.336690398 | 0.297639662 | 11.21050326 |
| ENSG00000179195 | 6902.95033 | 1.849119063 | 0.16497382 | 11.20856064 |
| ENSG00000101152 | 7175.037362 | −1.720960736 | 0.153561434 | −11.2069853 |
| ENSG00000234616 | 3043.958419 | −1.987898382 | 0.177420495 | −11.20444612 |
| ENSG00000185697 | 674.0150235 | 2.993885432 | 0.267261708 | 11.20207401 |
| ENSG00000121940 | 1096.922487 | 2.334910886 | 0.208448034 | 11.20140516 |
| ENSG00000262831 | 14087.32892 | −1.859908089 | 0.166217376 | −11.18961287 |
| ENSG00000109062 | 9123.073413 | −1.93494331 | 0.17294706 | −11.18806708 |
| ENSG00000108588 | 4062.645858 | 1.804402187 | 0.161302315 | 11.18646182 |
| ENSG00000012822 | 4324.027577 | −1.856189463 | 0.165937078 | −11.18610431 |
| ENSG00000170471 | 4203.071195 | 2.253829919 | 0.201663731 | 11.17617881 |
| ENSG00000089916 | 1838.42559 | 2.5182208 | 0.225342143 | 11.17509919 |
| ENSG00000159082 | 848.0318811 | 3.026499801 | 0.270897895 | 11.17210727 |
| ENSG00000146463 | 1359.166652 | 2.407968338 | 0.215538163 | 11.17188858 |
| ENSG00000171130 | 1540.862306 | −1.907159387 | 0.170716371 | −11.17150849 |
| ENSG00000205765 | 1917.701715 | 2.21716295 | 0.198488101 | 11.17025627 |
| ENSG00000172375 | 4420.802171 | −1.798579896 | 0.161022927 | −11.16971309 |
| ENSG00000167986 | 24428.41097 | −1.654272485 | 0.148112483 | −11.16902808 |
| ENSG00000166783 | 1974.941263 | 2.561213645 | 0.229314915 | 11.16897977 |
| ENSG00000116830 | 670.8556717 | 2.874081681 | 0.257352986 | 11.1678583 |
| ENSG00000169604 | 655.8935556 | 2.886330893 | 0.258502921 | 11.16556393 |
| ENSG00000175482 | 1322.682932 | −2.131031201 | 0.191009205 | −11.15669372 |
| ENSG00000197562 | 2233.315223 | −1.873310328 | 0.167947896 | −11.15411607 |
| ENSG00000132842 | 1848.273712 | 2.071865729 | 0.185812536 | 11.15030112 |
| ENSG00000168813 | 543.5840044 | 3.638591828 | 0.326417041 | 11.14706457 |
| ENSG00000104177 | 1494.457063 | 2.338326299 | 0.209810423 | 11.14494821 |
| ENSG00000106571 | 1043.55025 | 2.800877451 | 0.25154907 | 11.13451723 |
| ENSG00000089220 | 11246.22831 | −1.743422744 | 0.156597948 | −11.13311363 |
| ENSG00000168672 | 6389.515243 | 1.890774476 | 0.169846082 | 11.13228195 |
| ENSG00000135048 | 469.0603167 | 3.786328975 | 0.340138104 | 11.13174012 |
| ENSG00000140688 | 5282.870917 | −1.751173453 | 0.157319199 | −11.13133977 |
| ENSG00000116497 | 670.5074015 | 2.788372887 | 0.250511528 | 11.13071685 |
| ENSG00000099849 | 2005.268547 | −1.862643865 | 0.167498473 | −11.12036327 |
| ENSG00000001629 | 1710.424306 | 2.28764239 | 0.205774648 | 11.11722175 |
| ENSG00000186260 | 1833.981438 | 3.109153433 | 0.279737566 | 11.11453668 |
| ENSG00000126787 | 1375.618019 | 2.18608799 | 0.196765197 | 11.11013542 |
| ENSG00000072778 | 12518.48407 | 4.713294997 | 0.154214014 | −11.10985284 |
| ENSG00000176473 | 619.060992 | −2.240751141 | 0.201709692 | −11.10879264 |
| ENSG00000121064 | 2562.943741 | −1.798851624 | 0.161987082 | −11.10490786 |
| ENSG00000114439 | 2993.350798 | 2.558010793 | 0.230393634 | 11.10278418 |
| ENSG00000167552 | 3096.219175 | −1.821652654 | 0.164074896 | −11.10256775 |
| ENSG00000024526 | 732.2289217 | 2.854360022 | 0.257190436 | 11.09823548 |
| ENSG00000042493 | 3714.446953 | −1.89626484 | 0.170876216 | −11.0973012 |

TABLE 6-continued

| | | | | |
|---|---|---|---|---|
| ENSG00000130513 | 321.2806343 | −2.741722763 | 0.247215223 | −11.09042852 |
| ENSG00000121858 | 1515.078486 | 2.401607686 | 0.216615316 | 11.0869708 |
| ENSG00000204130 | 1179.833584 | 2.323600244 | 0.209592543 | 11.08627344 |
| ENSG00000132376 | 1603.55583 | −1.972323409 | 0.177952741 | −11.08341122 |
| ENSG00000087074 | 940.5067029 | −2.067609363 | 0.186563426 | −11.08260824 |
| ENSG00000118762 | 477.2905483 | 3.648516584 | 0.329516775 | 11.07232428 |
| ENSG00000198832 | 2043.240907 | −2.231859281 | 0.201625603 | −11.06932476 |
| ENSG00000137992 | 878.5295815 | 2.676860139 | 0.241854746 | 11.06804884 |
| ENSG00000166140 | 2380.107923 | −1.802542059 | 0.162873406 | −11.06713552 |
| ENSG00000123636 | 714.2912724 | 3.273313397 | 0.295795626 | 11.06613186 |
| ENSG00000143537 | 17612.60252 | −1.683301206 | 0.152120753 | −11.06555922 |
| ENSG00000072501 | 6348.776583 | 2.002606991 | 0.18106546 | 11.06012705 |
| ENSG00000075624 | 118406.4634 | −1.683243838 | 0.152222331 | −11.05779835 |
| ENSG00000115020 | 701.6277182 | 3.329532331 | 0.301112395 | 11.05744032 |
| ENSG00000269893 | 1235.990602 | −2.192757365 | 0.198312065 | −11.0571052 |
| ENSG00000012174 | 1251.900814 | 2.268906498 | 0.205240319 | 11.05487708 |
| ENSG00000122786 | 943.2612605 | 2.392678947 | 0.216475603 | 11.05288037 |
| ENSG00000133812 | 620.8988466 | 3.245288986 | 0.293695317 | 11.04984928 |
| ENSG00000119685 | 1289.175657 | 2.296688911 | 0.2078922 | 11.04749919 |
| ENSG00000254741 | 4336.988938 | −2.079303596 | 0.188241977 | −11.04590819 |
| ENSG00000115234 | 4029.080583 | −1.836199679 | 0.166265908 | −11.04375333 |
| ENSG00000168734 | 732.0101682 | −2.133726664 | 0.193215581 | −11.04324325 |
| ENSG00000171988 | 1625.04782 | 2.677776314 | 0.242629098 | 11.03650114 |
| ENSG00000187240 | 1399.775985 | 3.129856322 | 0.283785421 | 11.02895389 |
| ENSG00000184743 | 6022.801017 | 1.941007016 | 0.176005976 | 11.02807451 |
| ENSG00000101126 | 4922.070311 | 1.812294992 | 0.164390098 | 11.02435616 |
| ENSG00000103152 | 2359.343687 | −1.958459616 | 0.177701487 | −11.02106486 |
| ENSG00000130522 | 2899.891045 | −1.905245941 | 0.17288064 | −11.02058588 |
| ENSG00000135506 | 14348.75017 | −1.707309214 | 0.154960091 | −11.01773498 |
| ENSG00000269728 | 1017.539167 | 2.394108551 | 0.217342771 | 11.01535854 |
| ENSG00000167987 | 4471.131133 | −1.716590009 | 0.155859361 | −11.01371132 |
| ENSG00000230733 | 2232.415476 | −1.888805771 | 0.171583125 | 41.00810918 |
| ENSG00000163104 | 1003.696442 | 2.427831687 | 0.220572189 | 11.006971 |
| ENSG00000070961 | 1923.059423 | 2.083876044 | 0.189325374 | 11.00685024 |
| ENSG00000185000 | 2009.0092 | −1.947976534 | 0.176989623 | −11.0061624 |
| ENSG00000147274 | 3702.707921 | 1.798760853 | 0.163440361 | 11.00560988 |
| ENSG00000101986 | 572.1270116 | −2.321326643 | 0.210947815 | −11.00426966 |
| ENSG00000075568 | 1461.525197 | 2.340144575 | 0.212747735 | 10.99962159 |
| ENSG00000188643 | 8450.73904 | −1.812244549 | 0.164760119 | −10.99929137 |
| ENSG00000115053 | 9304.291878 | 1.880678979 | 0.171131442 | 10.98967529 |
| ENSG00000165732 | 5901.812157 | 1.720954309 | 0.156615239 | 10.98842184 |
| ENSG00000117472 | 998.4791538 | −2.238063754 | 0.203725905 | −10.98566113 |
| ENSG00000152104 | 3359.01036 | 2.69792719 | 0.245623643 | 10.98398819 |
| ENSG00000054267 | 2250.564118 | 2.112186571 | 0.192306068 | 10.98346293 |
| ENSG00000130396 | 1154.091353 | 2.918052221 | 0.265696441 | 10.98265451 |
| ENSG00000131437 | 1275.492501 | 2.210461226 | 0.201284428 | 10.9817796 |
| ENSG00000089157 | 56832.98392 | −1.816928885 | 0.165460927 | −10.98101479 |
| ENSG00000110841 | 1840.469787 | 2.045600429 | 0.18634273 | 10.97762401 |
| ENSG00000113407 | 1807.138846 | 2.061813681 | 0.187866031 | 10.97491481 |
| ENSG00000131408 | 2405.535389 | −1.914289516 | 0.174554979 | −10.96668529 |
| ENSG00000054611 | 1246.926351 | −1.947836702 | 0.177668229 | −10.96333718 |
| ENSG00000145685 | 1560.357624 | 2.229448066 | 0.203402721 | 10.96075831 |
| ENSG00000113658 | 1421.348886 | 2.305533586 | 0.210355181 | 10.96019395 |
| ENSG00000011426 | 4966.906564 | 2.228420749 | 0.203328823 | 10.95968944 |
| ENSG00000100578 | 721.0939314 | 2.997312645 | 0.273511023 | 10.95865393 |
| ENSG00000258725 | 629.0302856 | 2.869789025 | 0.26195467 | 10.95528864 |
| ENSG00000101846 | 899.9016522 | 2.94830662 | 0.269186571 | 10.9526512 |
| ENSG00000131043 | 3692.516578 | −1.750292843 | 0.159828943 | −10.95103809 |
| ENSG00000154639 | 1165.557547 | 2.185747691 | 0.199621902 | 10.94943827 |
| ENSG00000120549 | 1975.478574 | 2.147985917 | 0.196186791 | 10.94867759 |
| ENSG00000162290 | 598.8811439 | 2.870572594 | 0.262273582 | 10.94495516 |
| ENSG00000108639 | 15044.87751 | −1.690668008 | 0.154512839 | −10.94192575 |
| ENSG00000254004 | 679.3241811 | 2.765005032 | 0.252719537 | 10.9410023 |
| ENSG00000142541 | 24051.92895 | −1.90568559 | 0.174203859 | −10.9393994 |
| ENSG00000112739 | 3493.98809 | 1.961151901 | 0.17929993 | 10.93782862 |
| ENSG00000116062 | 2368.085098 | 1.905483386 | 0.174241234 | 10.93589242 |
| ENSG00000115756 | 981.6212876 | −2.215568165 | 0.202666761 | −10.93207467 |
| ENSG00000153827 | 4676.556146 | 2.02576594 | 0.185317624 | 10.93131832 |
| ENSG00000122417 | 1232.9353 | 2.460179704 | 0.225120563 | 10.92827627 |
| ENSG00000188883 | 540.8689806 | −2.26408647 | 0.207281085 | −10.92278375 |
| ENSG00000047365 | 1033.077578 | 2.8810697 | 0.263812031 | 10.92091854 |
| ENSG00000102189 | 2332.818013 | 2.626357423 | 0.240655324 | 10.91335684 |
| ENSG00000082805 | 1386.242893 | 2.552426214 | 0.233907943 | 10.91209723 |
| ENSG00000211450 | 2535.003126 | −2.064810446 | 0.189227938 | −10.91176316 |
| ENSG00000067221 | 809.5551804 | −2.152014764 | 0.197238612 | −10.91071747 |
| ENSG00000174953 | 1968.277821 | 1.941053817 | 0.178020977 | 10.90351178 |
| ENSG00000167671 | 3454.353438 | −1.852330107 | 0.169893958 | −10.90286043 |
| ENSG00000148290 | 3475.743884 | −1.905790978 | 0.17481818 | −10.90156059 |
| ENSG00000160180 | 726.3726175 | −2.278431963 | 0.209077692 | −10.8975374 |
| ENSG00000143303 | 2175.778756 | −1.802865947 | 0.165458613 | −10.89617466 |

TABLE 6-continued

| | | | | |
|---|---|---|---|---|
| ENSG00000007255 | 951.3370245 | −2.059490048 | 0.189070085 | −10.89273349 |
| ENSG00000135720 | 3082.277847 | 2.036483109 | 0.186965095 | 10.89231711 |
| ENSG00000124587 | 5047.066657 | −1.675020912 | 0.153794671 | −10.89128058 |
| ENSG00000100316 | 42936.06904 | −1.796373899 | 0.164994732 | −10.88746211 |
| ENSG00000143669 | 860.5629259 | 3.026054781 | 0.277994181 | 10.88531701 |
| ENSG00000092470 | 576.1859703 | 3.050937309 | 0.280300733 | 10.88451419 |
| ENSG00000168014 | 1615.861053 | 2.411691989 | 0.221578203 | 10.88415716 |
| ENSG00000134243 | 4032.957748 | 1.959148345 | 0.18004671 | 10.88133377 |
| ENSG00000101940 | 2377.864536 | −1.875890645 | 0.172440448 | −10.87848394 |
| ENSG00000007541 | 4255.271637 | −1.841956218 | 0.169369943 | −10.87534297 |
| ENSG00000135709 | 2266.708314 | −1.939414737 | 0.178348369 | −10.87430602 |
| ENSG00000151612 | 743.4866355 | 2.9759011 | 0.273718063 | 10.87214001 |
| ENSG00000171222 | 4484.141712 | −2.110255615 | 0.194099775 | −10.87201476 |
| ENSG00000149823 | 6245.935183 | −1.934355866 | 0.17793231 | −10.87130196 |
| ENSG00000087086 | 6025.594697 | −2.121701052 | 0.195190851 | −10.86987963 |
| ENSG00000101333 | 1682.768896 | 2.379476513 | 0.218984783 | 10.86594457 |
| ENSG00000169607 | 543.8558923 | 3.248503751 | 0.299025415 | 10.86363762 |
| ENSG00000117000 | 819.2762747 | 2.603557402 | 0.239688434 | 10.86225713 |
| ENSG00000198393 | 1095.651674 | 2.400217668 | 0.221056722 | 10.85792661 |
| ENSG00000163681 | 1178.05718 | 2.209548605 | 0.203559741 | 10.85454617 |
| ENSG00000168016 | 498.389222 | 3.429097106 | 0.315921542 | 10.85426806 |
| ENSG00000110344 | 4233.606298 | 2.037318407 | 0.187821689 | 10.84708809 |
| ENSG00000166025 | 1139.747267 | 2.306731924 | 0.21266245 | 10.84691692 |
| ENSG00000104866 | 3572.148374 | −1.720511666 | 0.158680155 | −10.84263916 |
| ENSG00000174292 | 1462.397278 | −1.864284566 | 0.171954117 | −10.84175591 |
| ENSG00000120063 | 1861.980192 | 2.086930974 | 0.19256007 | 10.83781792 |
| ENSG00000175866 | 2190.499988 | −1.824493547 | 0.168363503 | 40.83663329 |
| ENSG00000167767 | 5499.152176 | −2.29541269 | 0.211868595 | −10.83413373 |
| ENSG00000011405 | 1463.070759 | 2.580154438 | 0.238190867 | 10.83229794 |
| ENSG00000064393 | 1577.129096 | 3.008056044 | 0.27778544 | 10.82870308 |
| ENSG00000001631 | 908.1540287 | 2.530632826 | 0.233733115 | 10.82701876 |
| ENSG00000198858 | 2371.995432 | −1.975932389 | 0.182516626 | −10.82604055 |
| ENSG00000115468 | 7739.703933 | −1.680070061 | 0.155289781 | −10.8189351 |
| ENSG00000198399 | 696.9414552 | 2.685253657 | 0.24826781 | 10.81595577 |
| ENSG00000101347 | 1969.601928 | 2.148130566 | 0.198632838 | 10.81457923 |
| ENSG00000176108 | 1182.791643 | −2.029598931 | 0.187707217 | −10.81257802 |
| ENSG00000105671 | 2172.372341 | −2.049974415 | 0.189608607 | −10.81161053 |
| ENSG00000069011 | 2221.84526 | −2.016488324 | 0.186593084 | −10.80687603 |
| ENSG00000160445 | 4884.206141 | −1.6645118 | 0.154025851 | −10.80670414 |
| ENSG00000138629 | 2274.523239 | −1.896163635 | 0.175489697 | −10.80498554 |
| ENSG00000167642 | 15493.70883 | −1.708619223 | 0.158160734 | −10.80305576 |
| ENSG00000108219 | 5434.306818 | −1.656680922 | 0.153386412 | −10.80070199 |
| ENSG00000141741 | 2463.829326 | −1.917916376 | 0.177604804 | −10.79878657 |
| ENSG00000088280 | 3409.534068 | −1.704018191 | 0.157808139 | −10.79803743 |
| ENSG00000168172 | 2182.399905 | 2.413466911 | 0.223570319 | 10.79511323 |
| ENSG00000138642 | 825.2363255 | 2.788936486 | 0.258389821 | 10.79352302 |
| ENSG00000227500 | 3212.22403 | −1.727489487 | 0.160072321 | −10.79193124 |
| ENSG00000224383 | 309.5101208 | −2.742893187 | 0.254225574 | −10.78921034 |
| ENSG00000086544 | 1258.446399 | −1.993985212 | 0.184817021 | −10.78896955 |
| ENSG00000082497 | 1317.580134 | 2.273542414 | 0.210780997 | 10.78627792 |
| ENSG00000122566 | 24929.99255 | 1.67132251 | 0.154950286 | 10.78618538 |
| ENSG00000168769 | 714.5271212 | 3.436936587 | 0.318708541 | 10.78394879 |
| ENSG00000129103 | 12040.24333 | −1.753998629 | 0.162709074 | −10.77996814 |
| ENSG00000139318 | 647.9512476 | 3.133929625 | 0.290821143 | 10.77647444 |
| ENSG00000196305 | 3196.869599 | 1.783172158 | 0.165479178 | 10.77580986 |
| ENSG00000003756 | 2124.780691 | 1.890100093 | 0.175409533 | 10.77535557 |
| ENSG00000090612 | 909.8090822 | 2.349055713 | 0.218021949 | 10.7744001 |
| ENSG00000140694 | 1151.891833 | 2.150977728 | 0.199750447 | 10.76832499 |
| ENSG00000134852 | 899.5644037 | 2.799465024 | 0.26000221 | 10.76708163 |
| ENSG00000151503 | 4853.208071 | 1.85552155 | 0.172481417 | 10.75780558 |
| ENSG00000070214 | 6563.337379 | 1.841533022 | 0.17120435 | 10.75634484 |
| ENSG00000101350 | 3793.230122 | 1.854243185 | 0.172386139 | 10.75633574 |
| ENSG00000171444 | 2377.793413 | 2.142483476 | 0.199343798 | 10.7476806 |
| ENSG00000104081 | 866.9347501 | −2.396755958 | 0.223026357 | 40.7465144 |
| ENSG00000163946 | 2220.082947 | 1.957289502 | 0.182133373 | 10.74646272 |
| ENSG00000158828 | 1264.628642 | −1.923283236 | 0.178972385 | −10.74625695 |
| ENSG00000141219 | 735.5137828 | 2.522564934 | 0.234743395 | 10.74605287 |
| ENSG00000143801 | 1006.900236 | −1.993525764 | 0.18552475 | −10.74533596 |
| ENSG00000106080 | 798.1330226 | 2.44827692 | 0.227878426 | 10.74378544 |
| ENSG00000131165 | 9815.824483 | −1.73123887 | 0.161144544 | −10.74339115 |
| ENSG00000091009 | 1766.394568 | 2.061150253 | 0.191867033 | 10.7425972 |
| ENSG00000104142 | 2446.898327 | −1.784823366 | 0.166164827 | −10.74128261 |
| ENSG00000070404 | 1123.650171 | −2.189307852 | 0.203867863 | −10.73885713 |
| ENSG00000160948 | 4265.380267 | −1.870433915 | 0.17422865 | −10.73551285 |
| ENSG00000121680 | 2332.799111 | −1.96087904 | 0.182658629 | −10.73521162 |
| ENSG00000056097 | 2165.51022 | 1.988673892 | 0.185342216 | 10.72974058 |
| ENSG00000184292 | 11866.18947 | −1.774983333 | 0.165473381 | −10.72670008 |
| ENSG00000015676 | 7712.597309 | −1.65762776 | 0.15454054 | −10.72616775 |
| ENSG00000126062 | 2140.141106 | −1.875421318 | 0.174868831 | −10.72473183 |
| ENSG00000129315 | 2441.228693 | 1.98264092 | 0.184898456 | 10.72286358 |

TABLE 6-continued

| | | | | |
|---|---|---|---|---|
| ENSG00000105357 | 4457.042023 | −1.659299357 | 0.154748501 | −10.72255526 |
| ENSG00000164081 | 1838.400187 | −1.875926382 | 0.175019574 | −10.71838047 |
| ENSG00000158417 | 2384.102107 | 2.043716232 | 0.19073753 | 10.71480914 |
| ENSG00000167965 | 1942.750314 | −1.870313448 | 0.174570387 | −10.71380711 |
| ENSG00000115183 | 1338.378009 | 2.335296906 | 0.217978141 | 10.71344537 |
| ENSG00000173674 | 2730.102591 | 1.888190332 | 0.176247087 | 10.71331369 |
| ENSG00000103064 | 2606.498852 | 1.880063378 | 0.17549178 | 10.71311359 |
| ENSG00000158710 | 13524.25531 | 4.74470242 | 0.162906121 | −10.70986415 |
| ENSG00000064601 | 8423.765117 | −1.776728283 | 0.165949424 | −10.70644443 |
| ENSG00000131242 | 2017.054816 | −1.821615185 | 0.170147679 | −10.70608308 |
| ENSG00000179218 | 75362.28503 | −1.672387079 | 0.156215829 | −10.70561858 |
| ENSG00000100284 | 1556.771974 | −1.934753758 | 0.180728778 | −10.70528875 |
| ENSG00000100227 | 4525.905848 | −1.665981195 | 0.155660195 | −10.70267962 |
| ENSG00000056586 | 2377.381785 | 2.103164194 | 0.196514871 | 10.7023157 |
| ENSG00000135069 | 1381.221328 | 2.18403585 | 0.20409885 | 10.70087286 |
| ENSG00000167565 | 1296.420538 | −1.916465949 | 0.179106355 | −10.70015608 |
| ENSG00000151893 | 2161.950171 | 1.943251953 | 0.181616945 | 10.69972823 |
| ENSG00000136628 | 5139.434381 | 1.785633887 | 0.166891095 | 10.69939584 |
| ENSG00000255455 | 440.294803 | 3.749256591 | 0.350601001 | 10.69379888 |

| | pvalue | padj | hgnc_symbol | entrezgene |
|---|---|---|---|---|
| ENSG00000167653 | 3.30E−190 | 7.54E−186 | PSCA | 8000 |
| ENSG00000170099 | 1.20E−149 | 1.36E−145 | SERPINA6 | 866 |
| ENSG00000131747 | 2.49E−137 | 1.90E−133 | TOP2A | 7153 |
| ENSG00000165272 | 2.00E−119 | 1.14E−115 | AQP3 | 360 |
| ENSG00000117724 | 6.33E−118 | 2.89E−114 | CENPF | 1063 |
| ENSG00000058673 | 4.47E−117 | 1.70E−113 | NA | NA |
| ENSG00000047410 | 1.84E−110 | 6.00E−107 | TPR | 7175 |
| ENSG00000137975 | 7.68E−106 | 2.19E−102 | CLCA2 | 9635 |
| ENSG00000214708 | 6.58E−105 | 1.67E−101 | NA | NA |
| ENSG00000133706 | 7.42E−101 | 1.70E−97 | LARS | 51520 |
| ENSG00000106211 | 7.75E−97 | 1.61E−93 | HSPB1 | 3315 |
| ENSG00000148773 | 5.32E−96 | 1.01E−92 | MKI67 | 4288 |
| ENSG00000092201 | 2.19E−93 | 3.84E−90 | SUPT16H | 11198 |
| ENSG00000100941 | 7.32E−89 | 1.19E−85 | PNN | 5411 |
| ENSG00000197249 | 1.09E−88 | 1.66E−85 | SERPINA1 | 5265 |
| ENSG00000173230 | 4.79E−85 | 6.84E−82 | GOLGB1 | 2804 |
| ENSG00000162078 | 3.52E−84 | 4.73E−81 | ZG16B | 124220 |
| ENSG00000155561 | 1.08E−83 | 1.37E−80 | NUP205 | 23165 |
| ENSG00000253729 | 5.40E−83 | 6.49E−80 | PRKDC | 5591 |
| ENSG00000173193 | 1.22E−80 | 1.39E−77 | PARP14 | 54625 |
| ENSG00000102003 | 1.73E−80 | 1.88E−77 | SYP | 6855 |
| ENSG00000009954 | 1.84E−80 | 1.91E−77 | BAZ1B | 9031 |
| ENSG00000186160 | 3.85E−78 | 3.82E−75 | CYP4Z1 | 199974 |
| ENSG00000175216 | 2.20E−77 | 2.09E−74 | CKAP5 | 9793 |
| ENSG00000104517 | 2.03E−76 | 1.85E−73 | UBR5 | 51366 |
| ENSG00000168539 | 7.56E−76 | 6.63E−73 | CHRM1 | 1128 |
| ENSG00000119231 | 1.66E−75 | 1.40E−72 | SENP5 | 205564 |
| ENSG00000138246 | 4.04E−75 | 3.30E−72 | DNAJC13 | 23317 |
| ENSG00000090661 | 1.06E−74 | 8.37E−72 | CERS4 | 79603 |
| ENSG00000182481 | 3.72E−73 | 2.83E−70 | KPNA2 | 3838 |
| ENSG00000124486 | 2.36E−72 | 1.74E−69 | USP9X | 8239 |
| ENSG00000064651 | 9.13E−72 | 6.51E−69 | SLC12A2 | 6558 |
| ENSG00000144674 | 1.45E−71 | 1.01E−68 | GOLGA4 | 2803 |
| ENSG00000114346 | 2.26E−71 | 1.52E−68 | ECT2 | 1894 |
| ENSG00000008196 | 2.39E−71 | 1.56E−68 | TFAP2B | 7021 |
| ENSG00000055332 | 8.72E−71 | 5.53E−68 | EIF2AK2 | 5610 |
| ENSG00000182670 | 9.71E−71 | 5.99E−68 | TTC3 | 7267 |
| ENSG00000198125 | 2.04E−70 | 1.23E−67 | MB | 4151 |
| ENSG00000104419 | 7.34E−70 | 4.30E−67 | NDRG1 | 10397 |
| ENSG00000140575 | 1.36E−69 | 7.77E−67 | IQGAP1 | 8826 |
| ENSG00000183569 | 1.86E−69 | 1.03E−66 | SERHL2 | 253190 |
| ENSG00000189057 | 1.92E−69 | 1.04E−66 | FAM111B | 374393 |
| ENSG00000166801 | 2.08E−69 | 1.10E−66 | FAM111A | 63901 |
| ENSG00000151914 | 2.42E−69 | 1.25E−66 | DST | 667 |
| ENSG00000258486 | 1.09E−68 | 5.52E−66 | NA | NA |
| ENSG00000145833 | 1.88E−68 | 9.36E−66 | DDX46 | 9879 |
| ENSG00000107290 | 1.62E−67 | 7.88E−65 | SETX | 23064 |
| ENSG00000115221 | 2.27E−67 | 1.08E−64 | NA | NA |
| ENSG00000156802 | 2.59E−67 | 1.21E−64 | ATAD2 | 29028 |
| ENSG00000125107 | 4.15E−67 | 1.90E−64 | CNOT1 | 23019 |
| ENSG00000120800 | 7.31E−67 | 3.27E−64 | UTP20 | 27340 |
| ENSG00000164171 | 1.83E−66 | 8.03E−64 | ITGA2 | 3673 |
| ENSG00000196914 | 3.90E−66 | 1.68E−63 | ARHGEF12 | 23365 |
| ENSG00000251562 | 5.21E−66 | 2.20E−63 | MALAT1 | 378938 |
| ENSG00000196712 | 6.45E−66 | 2.68E−63 | NF1 | 4763 |
| ENSG00000165733 | 3.55E−65 | 1.45E−62 | BMS1 | 9790 |
| ENSG00000135679 | 3.42E−64 | 1.37E−61 | MDM2 | 4193 |
| ENSG00000108424 | 5.57E−64 | 2.19E−61 | KPNB1 | 3837 |

TABLE 6-continued

| | | | | |
|---|---|---|---|---|
| ENSG00000169045 | 6.37E−64 | 2.46E−61 | HNRNPH1 | 3187 |
| ENSG00000153201 | 8.81E−64 | 3.35E−61 | RANBP2 | 5903 |
| ENSG00000163781 | 9.98E−64 | 3.74E−61 | TOPBP1 | 11073 |
| ENSG00000157106 | 1.15E−63 | 4.23E−61 | SMG1 | 23049 |
| ENSG00000078124 | 1.22E−63 | 4.43E−61 | ACER3 | 55331 |
| ENSG00000198363 | 2.08E−63 | 7.43E−61 | ASPH | 444 |
| ENSG00000153207 | 2.50E−63 | 8.78E−61 | AHCTF1 | 25909 |
| ENSG00000143416 | 2.10E−62 | 7.27E−60 | SELENBP1 | 8991 |
| ENSG00000165671 | 4.86E−62 | 1.66E−59 | NSD1 | 64324 |
| ENSG00000163840 | 9.49E−62 | 3.19E−59 | DTX3L | 151636 |
| ENSG00000147862 | 1.02E−61 | 3.39E−59 | NFIB | 4781 |
| ENSG00000124151 | 1.56E−61 | 5.10E−59 | NCOA3 | 8202 |
| ENSG00000108055 | 4.23E−61 | 1.36E−58 | SMC3 | 9126 |
| ENSG00000114857 | 8.34E−61 | 2.64E−58 | NKTR | 4820 |
| ENSG00000178202 | 1.04E−60 | 3.25E−58 | KDELC2 | 143888 |
| ENSG00000101868 | 1.29E−60 | 3.97E−58 | POLA1 | 5422 |
| ENSG00000119969 | 1.40E−60 | 4.27E−58 | HELLS | 3070 |
| ENSG00000154198 | 2.87E−60 | 8.63E−58 | CYP4Z2P | 163720 |
| ENSG00000094916 | 7.90E−60 | 2.34E−57 | CBX5 | 23468 |
| ENSG00000138160 | 1.45E−59 | 4.25E−57 | KIF11 | 3832 |
| ENSG00000196074 | 2.08E−59 | 6.02E−57 | SYCP2 | 10388 |
| ENSG00000167608 | 2.14E−59 | 6.12E−57 | TMC4 | 147798 |
| ENSG00000153914 | 2.24E−59 | 6.32E−57 | SREK1 | 140890 |
| ENSG00000121892 | 3.72E−59 | 1.03E−56 | PDS5A | 23244 |
| ENSG00000099194 | 6.03E−59 | 1.66E−56 | SCD | 6319 |
| ENSG00000180182 | 1.09E−58 | 2.97E−56 | MED14 | 9282 |
| ENSG00000108256 | 1.22E−58 | 3.28E−56 | NUFIP2 | 57532 |
| ENSG00000163435 | 1.25E−58 | 3.32E−56 | ELF3 | 1999 |
| ENSG00000164684 | 1.35E−58 | 3.53E−56 | ZNF704 | 619279 |
| ENSG00000066777 | 1.68E−58 | 4.36E−56 | ARFGEF1 | 10565 |
| ENSG00000171634 | 4.02E−58 | 1.03E−55 | BPTF | 2186 |
| ENSG00000163714 | 8.48E−58 | 2.15E−55 | U2SURP | 23350 |
| ENSG00000143476 | 1.31E−57 | 3.29E−55 | DTL | 51514 |
| ENSG00000030066 | 1.37E−57 | 3.39E−55 | NUP160 | 23279 |
| ENSG00000198408 | 1.46E−57 | 3.58E−55 | MGEA5 | 10724 |
| ENSG00000138758 | 3.14E−57 | 7.62E−55 | 10-Sep | 55752 |
| ENSG00000117523 | 5.76E−57 | 1.39E−54 | PRRC2C | 23215 |
| ENSG00000151461 | 6.34E−57 | 1.51E−54 | UPF2 | 26019 |
| ENSG00000106261 | 7.00E−57 | 1.65E−54 | ZKSCAN1 | 7586 |
| ENSG00000225339 | 7.30E−57 | 1.70E−54 | NA | NA |
| ENSG00000111335 | 8.88E−57 | 2.05E−54 | OAS2 | 4939 |
| ENSG00000143324 | 1.00E−56 | 2.29E−54 | XPR1 | 9213 |
| ENSG00000198625 | 1.31E−56 | 2.97E−54 | MDM4 | 4194 |
| ENSG00000124831 | 1.52E−56 | 3.41E−54 | LRRFIP1 | 9208 |
| ENSG00000158711 | 1.77E−56 | 3.93E−54 | ELK4 | 2005 |
| ENSG00000116539 | 3.78E−56 | 8.30E−54 | ASH1L | 55870 |
| ENSG00000171316 | 6.75E−56 | 1.47E−53 | CHD7 | 55636 |
| ENSG00000113013 | 8.14E−56 | 1.75E−53 | HSPA9 | 3313 |
| ENSG00000198589 | 9.61E−56 | 2.05E−53 | LRBA | 987 |
| ENSG00000141367 | 1.51E−55 | 3.19E−53 | CLTC | 1213 |
| ENSG00000126777 | 1.87E−55 | 3.93E−53 | KTN1 | 3895 |
| ENSG00000164190 | 4.03E−55 | 8.36E−53 | NIPBL | 25836 |
| ENSG00000109586 | 6.87E−55 | 1.41E−52 | GALNT7 | 51809 |
| ENSG00000119707 | 1.67E−54 | 3.40E−52 | RBM25 | 58517 |
| ENSG00000197599 | 3.22E−54 | 6.50E−52 | CCDC154 | 645811 |
| ENSG00000181555 | 4.84E−54 | 9.69E−52 | SETD2 | 29072 |
| ENSG00000146918 | 6.86E−54 | 1.36E−51 | NCAPG2 | 54892 |
| ENSG00000048649 | 8.92E−54 | 1.76E−51 | RSF1 | 51773 |
| ENSG00000166181 | 1.06E−53 | 2.07E−51 | API5 | 8539 |
| ENSG00000175054 | L67E−53 | 3.23E−51 | ATR | 545 |
| ENSG00000075292 | 2.47E−53 | 4.74E−51 | ZNF638 | 27332 |
| ENSG00000170759 | 2.74E−53 | 5.21E−51 | KIF5B | 3799 |
| ENSG00000113300 | 4.96E−53 | 9.36E−51 | CNOT6 | 57472 |
| ENSG00000159140 | 6.09E−53 | 1.14E−50 | SON | 6651 |
| ENSG00000100100 | 8.27E−53 | 1.53E−50 | PIK3IP1 | 113791 |
| ENSG00000187244 | 9.59E−53 | 1.77E−50 | BCAM | 4059 |
| ENSG00000148671 | 1.69E−52 | 3.09E−50 | ADIRF | 10974 |
| ENSG00000025796 | 3.84E−52 | 6.95E−50 | SEC63 | 11231 |
| ENSG00000067704 | 4.68E−52 | 8.42E−50 | IARS2 | 55699 |
| ENSG00000075539 | 1.07E−51 | 1.91E−49 | FRYL | 285527 |
| ENSG00000080345 | 1.78E−51 | 3.14E−49 | RIF1 | 55183 |
| ENSG00000069248 | 4.69E−51 | 8.24E−49 | NUP133 | 55746 |
| ENSG00000069431 | 6.99E−51 | 1.21E−48 | ABCC9 | 10060 |
| ENSG00000125676 | 7.01E−51 | 1.21E−48 | THOC2 | 57187 |
| ENSG00000139697 | 7.17E−51 | 1.23E−48 | SBNO1 | 55206 |
| ENSG00000060749 | 7.68E−51 | 1.31E−48 | QSER1 | 79832 |
| ENSG00000138688 | 7.93E−51 | 1.34E−48 | KIAA1109 | 84162 |
| ENSG00000162599 | 1.05E−50 | 1.77E−48 | NFIA | 4774 |
| ENSG00000183530 | 1.20E−50 | 2.00E−48 | PRR14L | 253143 |
| ENSG00000175567 | 1.32E−50 | 2.19E−48 | UCP2 | 7351 |

TABLE 6-continued

| | | | | |
|---|---|---|---|---|
| ENSG00000115464 | 1.43E−50 | 2.35E−48 | USP34 | 9736 |
| ENSG00000165219 | 1.66E−50 | 2.71E−48 | GAPVD1 | 26130 |
| ENSG00000259758 | 2.01E−50 | 3.26E−48 | NA | NA |
| ENSG00000125885 | 2.73E−50 | 4.39E−48 | MCM8 | 84515 |
| ENSG00000169905 | 3.08E−50 | 4.92E−48 | TOR1AIP2 | 163590 |
| ENSG00000127603 | 4.49E−50 | 7.12E−48 | NA | NA |
| ENSG00000093000 | 5.00E−50 | 7.88E−48 | NUP50 | 10762 |
| ENSG00000162402 | 7.55E−50 | 1.18E−47 | USP24 | 23358 |
| ENSG00000012048 | 1.03E−49 | 1.59E−47 | BRCA1 | 672 |
| ENSG00000060237 | 1.16E−49 | 1.79E−47 | WNK1 | 65125 |
| ENSG00000096696 | 1.39E−49 | 2.14E−47 | DSP | 1832 |
| ENSG00000136813 | 1.52E−49 | 2.31E−47 | KIAA0368 | 23392 |
| ENSG00000162896 | 2.00E−49 | 3.02E−47 | PIGR | 5284 |
| ENSG00000005810 | 2.43E−49 | 3.66E−47 | MYCBP2 | 23077 |
| ENSG00000109920 | 3.74E−49 | 5.58E−47 | FNBP4 | 23360 |
| ENSG00000173889 | 4.28E−49 | 6.34E−47 | PHC3 | 80012 |
| ENSG00000091409 | 4.41E−49 | 6.50E−47 | ITGA6 | 3655 |
| ENSG00000090905 | 5.46E−49 | 7.99E−47 | TNRC6A | 27327 |
| ENSG00000075151 | 6.11E−49 | 8.88E−47 | EIF4G3 | 8672 |
| ENSG00000087470 | 7.55E−49 | 1.09E−46 | DNM1L | 10059 |
| ENSG00000138443 | 1.10E−48 | 1.58E−46 | ABI2 | 10152 |
| ENSG00000095951 | 1.24E−48 | 1.77E−46 | HIVEP1 | 3096 |
| ENSG00000185442 | 1.38E−48 | 1.96E−46 | FAM174B | 400451 |
| ENSG00000138180 | 1.40E−48 | 1.96E−46 | CEP55 | 55165 |
| ENSG00000066739 | 1.40E−48 | 1.96E−46 | ATG2B | 55102 |
| ENSG00000134313 | 1.64E−48 | 2.29E−46 | KIDINS220 | 57498 |
| ENSG00000132780 | 1.67E−48 | 2.31E−46 | NASP | 4678 |
| ENSG00000070159 | 1.68E−48 | 2.31E−46 | PTPN3 | 5774 |
| ENSG00000176046 | 1.90E−48 | 2.60E−46 | NUPR1 | 26471 |
| ENSG00000165795 | 4.31E−48 | 5.86E−46 | NDRG2 | 57447 |
| ENSG00000198740 | 4.46E−48 | 6.03E−46 | ZNF652 | 22834 |
| ENSG00000113810 | 4.49E−48 | 6.04E−46 | SMC4 | 10051 |
| ENSG00000123200 | 5.08E−48 | 6.79E−46 | ZC3H13 | 23091 |
| ENSG00000187079 | 6.14E−48 | 8.15E−46 | TEAD1 | 7003 |
| ENSG00000088325 | 6.38E−48 | 8.42E−46 | TPX2 | 22974 |
| ENSG00000084093 | 6.85E−48 | 8.99E−46 | REST | 5978 |
| ENSG00000112297 | 7.00E−48 | 9.14E−46 | AIM1 | 202 |
| ENSG00000095739 | 7.68E−48 | 9.96E−46 | BAMBI | 25805 |
| ENSG00000245532 | 8.18E−48 | 1.05E−45 | NEAT1 | 283131 |
| ENSG00000108021 | 8.37E−48 | 1.07E−45 | FAM208B | 54906 |
| ENSG00000011454 | 8.80E−48 | 1.12E−45 | NA | NA |
| ENSG00000051825 | 1.35E−47 | 1.72E−45 | MPHOSPH9 | 10198 |
| ENSG00000021776 | 1.67E−47 | 2.11E−45 | AQR | 9716 |
| ENSG00000136731 | 2.52E−47 | 3.16E−45 | UGGT1 | 56886 |
| ENSG00000132466 | 2.62E−47 | 3.27E−45 | ANKRD17 | 26057 |
| ENSG00000109610 | 3.44E−47 | 4.27E−45 | SOD3 | 6649 |
| ENSG00000135480 | 3.69E−47 | 4.56E−45 | KRT7 | 3855 |
| ENSG00000198901 | 4.04E−47 | 4.96E−45 | PRC1 | 9055 |
| ENSG00000183018 | 5.67E−47 | 6.92E−45 | SPNS2 | 124976 |
| ENSG00000132849 | 6.96E−47 | 8.45E−45 | INADL | 10207 |
| ENSG00000067369 | 8.51E−47 | 1.03E−44 | TP53BP1 | 7158 |
| ENSG00000184445 | 1.09E−46 | 1.31E−44 | KNTC1 | 9735 |
| ENSG00000148143 | 1.11E−46 | 1.33E−44 | ZNF462 | 58499 |
| ENSG00000205268 | 1.42E−46 | 1.69E−44 | PDE7A | 5150 |
| ENSG00000100888 | 1.61E−46 | 1.91E−44 | CHD8 | 57680 |
| ENSG00000263244 | 2.23E−46 | 2.63E−44 | NA | NA |
| ENSG00000153107 | 2.47E−46 | 2.89E−44 | ANAPC1 | 64682 |
| ENSG00000197312 | 2.85E−46 | 3.32E−44 | DDI2 | 84301 |
| ENSG00000171345 | 3.15E−46 | 3.65E−44 | KRT19 | 3880 |
| ENSG00000198604 | 3.80E−46 | 4.38E−44 | BAZ1A | 11177 |
| ENSG00000102893 | 3.97E−46 | 4.55E−44 | PHKB | 5257 |
| ENSG00000068878 | 4.63E−46 | 5.28E−44 | PSME4 | 23198 |
| ENSG00000163625 | 4.82E−46 | 5.48E−44 | WDFY3 | 23001 |
| ENSG00000114030 | 6.24E−46 | 7.05E−44 | KPNA1 | 3836 |
| ENSG00000198879 | 6.27E−46 | 7.05E−44 | SFMBT2 | 57713 |
| ENSG00000133401 | 6.58E−46 | 7.36E−44 | PDZD2 | 23037 |
| ENSG00000099812 | 9.64E−46 | 1.07E−43 | MISP | 126353 |
| ENSG00000101474 | 1.05E−45 | 1.16E−43 | APMAP | 57136 |
| ENSG00000163960 | 1.11E−45 | 1.22E−43 | UBXN7 | 26043 |
| ENSG00000138182 | 1.54E−45 | 1.69E−43 | KIF20B | 9585 |
| ENSG00000095787 | 1.68E−45 | 1.84E−43 | WAC | 51322 |
| ENSG00000118200 | 1.78E−45 | 1.94E−43 | CAMSAP2 | 23271 |
| ENSG00000114573 | 1.81E−45 | 1.96E−43 | ATP6V1A | 523 |
| ENSG00000139218 | 1.90E−45 | 2.04E−43 | SCAF11 | 9169 |
| ENSG00000135164 | 1.97E−45 | 2.11E−43 | DMTF1 | 9988 |
| ENSG00000144554 | 2.13E−45 | 2.27E−43 | FANCD2 | 2177 |
| ENSG00000166145 | 2.29E−45 | 2.43E−43 | SPINT1 | 6692 |
| ENSG00000144485 | 2.51E−45 | 2.65E−43 | HES6 | 55502 |
| ENSG00000159658 | 2.57E−45 | 2.71E−43 | EFCAB14 | 9813 |
| ENSG00000189079 | 3.07E−45 | 3.22E−43 | ARID2 | 196528 |

TABLE 6-continued

| | | | | |
|---|---|---|---|---|
| ENSG00000144452 | 6.33E−45 | 6.60E−43 | ABCA12 | 26154 |
| ENSG00000257002 | 6.58E−45 | 6.83E−43 | NA | NA |
| ENSG00000060339 | 7.46E−45 | 7.71E−43 | CCAR1 | 55749 |
| ENSG00000152926 | 7.58E−45 | 7.80E−43 | ZNF117 | 51351 |
| ENSG00000035928 | 9.26E−45 | 9.48E−43 | RFC1 | 5981 |
| ENSG00000137713 | 1.14E−44 | 1.16E−42 | PPP2R1B | 5519 |
| ENSG00000170421 | 1.20E−44 | 1.22E−42 | KRT8 | 3856 |
| ENSG00000116977 | 1.37E−44 | 1.38E−42 | LGALS8 | 3964 |
| ENSG00000166747 | 1.55E−44 | 1.56E−42 | AP1G1 | 164 |
| ENSG00000004534 | 1.76E−44 | 1.76E−42 | RBM6 | 10180 |
| ENSG00000112159 | 2.06E−44 | 2.06E−42 | MDN1 | 23195 |
| ENSG00000143190 | 2.15E−44 | 2.14E−42 | POU2F1 | 5451 |
| ENSG00000170871 | 2.75E−44 | 2.72E−42 | KIAA0232 | 9778 |
| ENSG00000120875 | 2.94E−44 | 2.89E−42 | DUSP4 | 1846 |
| ENSG00000156453 | 4.01E−44 | 3.93E−42 | PCDH1 | 5097 |
| ENSG00000099204 | 4.13E−44 | 4.03E−42 | ABLIM1 | 3983 |
| ENSG00000143578 | 4.52E−44 | 4.40E−42 | CREB3L4 | 148327 |
| ENSG00000173166 | 6.03E−44 | 5.83E−42 | RAPH1 | 65059 |
| ENSG00000111371 | 6.51E−44 | 6.27E−42 | SLC38A1 | 81539 |
| ENSG00000153113 | 6.58E−44 | 6.32E−42 | CAST | 831 |
| ENSG00000198087 | 8.42E−44 | 8.04E−42 | CD2AP | 23607 |
| ENSG00000096746 | 9.00E−44 | 8.56E−42 | HNRNPH3 | 3189 |
| ENSG00000185219 | 1.00E−43 | 9.48E−42 | ZNF445 | 353274 |
| ENSG00000145675 | 1.10E−43 | 1.04E−41 | PIK3R1 | 5295 |
| ENSG00000197956 | 1.21E−43 | 1.14E−41 | S100A6 | 6277 |
| ENSG00000145198 | 1.27E−43 | 1.19E−41 | VWA5B2 | 90113 |
| ENSG00000177119 | 1.29E−43 | 1.20E−41 | ANO6 | 196527 |
| ENSG00000260032 | 1.39E−43 | 1.29E−41 | LINC00657 | 647979 |
| ENSG00000197594 | 2.35E−43 | 2.17E−41 | ENPP1 | 5167 |
| ENSG00000113569 | 2.88E−43 | 2.66E−41 | NUP155 | 9631 |
| ENSG00000184564 | 2.96E−43 | 2.71E−41 | SLITRK6 | 84189 |
| ENSG00000116005 | 3.56E−43 | 3.25E−41 | PCYOX1 | 51449 |
| ENSG00000090013 | 3.91E−43 | 3.56E−41 | BLVRB | 645 |
| ENSG00000091436 | 3.95E−43 | 3.58E−41 | ZAK | 51776 |
| ENSG00000134909 | 4.17E−43 | 3.77E−41 | ARHGAP32 | 9743 |
| ENSG00000187837 | 5.37E−43 | 4.83E−41 | HIST1H1C | 3006 |
| ENSG00000174197 | 5.73E−43 | 5.13E−41 | MGA | 23269 |
| ENSG00000126458 | 6.33E−43 | 5.65E−41 | RRAS | 6237 |
| ENSG00000198265 | 6.50E−43 | 5.78E−41 | HELZ | 9931 |
| ENSG00000102038 | 9.89E−43 | 8.75E−41 | SMARCA1 | 6594 |
| ENSG00000085224 | 1.00E−42 | 8.83E−41 | ATRX | 546 |
| ENSG00000135837 | 1.22E−42 | 1.07E−40 | CEP350 | 9857 |
| ENSG00000173575 | 1.67E−42 | 1.46E−40 | CHD2 | 1106 |
| ENSG00000108510 | 1.95E−42 | 1.70E−40 | MED13 | 9969 |
| ENSG00000119314 | 2.70E−42 | 2.35E−40 | PTBP3 | 9991 |
| ENSG00000110395 | 2.81E−42 | 2.43E−40 | CBL | 867 |
| ENSG00000106462 | 3.14E−42 | 2.70E−40 | EZH2 | 2146 |
| ENSG00000124466 | 3.40E−42 | 2.92E−40 | LYPD3 | 27076 |
| ENSG00000100503 | 3.57E−42 | 3.05E−40 | NIN | 51199 |
| ENSG00000120594 | 3.58E−42 | 3.05E−40 | PLXDC2 | 84898 |
| ENSG00000172725 | 3.88E−42 | 3.30E−40 | CORO1B | 57175 |
| ENSG00000147642 | 4.20E−42 | 3.55E−40 | SYBU | 55638 |
| ENSG00000163428 | 4.22E−42 | 3.55E−40 | LRRC58 | 116064 |
| ENSG00000165934 | 4.43E−42 | 3.72E−40 | CPSF2 | 53981 |
| ENSG00000134982 | 4.66E−42 | 3.89E−40 | APC | 324 |
| ENSG00000084676 | 4.99E−42 | 4.16E−40 | NCOA1 | 8648 |
| ENSG00000136861 | 5.29E−42 | 4.37E−40 | CDK5RAP2 | 55755 |
| ENSG00000143891 | 5.29E−42 | 4.37E−40 | GALM | 130589 |
| ENSG00000184828 | 5.50E−42 | 4.53E−40 | ZBTB7C | 201501 |
| ENSG00000185009 | 6.41E−42 | 5.27E−40 | AP3M1 | 26985 |
| ENSG00000078674 | 9.08E−42 | 7.43E−40 | PCM1 | 5108 |
| ENSG00000118873 | 9.94E−42 | 8.11E−40 | RAB3GAP2 | 25782 |
| ENSG00000118193 | 1.12E−41 | 9.10E−40 | KIF14 | 9928 |
| ENSG00000161800 | 1.57E−41 | 1.27E−39 | RACGAP1 | 29127 |
| ENSG00000115457 | 1.64E−41 | 1.33E−39 | IGFBP2 | 3485 |
| ENSG00000171298 | 1.69E−41 | 1.36E−39 | GAA | 2548 |
| ENSG00000090686 | 1.73E−41 | 1.39E−39 | USP48 | 84196 |
| ENSG00000048707 | 2.21E−41 | 1.76E−39 | VPS13D | 55187 |
| ENSG00000092148 | 2.25E−41 | 1.79E−39 | HECTD1 | 25831 |
| ENSG00000118058 | 2.47E−41 | 1.96E−39 | KMT2A | 4297 |
| ENSG00000030582 | 3.88E−41 | 3.07E−39 | GRN | 2896 |
| ENSG00000103260 | 4.09E−41 | 3.22E−39 | METRN | 79006 |
| ENSG00000163872 | 4.24E−41 | 3.33E−39 | YEATS2 | 55689 |
| ENSG00000185621 | 4.48E−41 | 3.50E−39 | LMLN | 89782 |
| ENSG00000100697 | 4.65E−41 | 3.62E−39 | DICER1 | 23405 |
| ENSG00000137807 | 5.43E−41 | 4.22E−39 | KIF23 | 9493 |
| ENSG00000166881 | 6.01E−41 | 4.65E−39 | NEMP1 | 23306 |
| ENSG00000112964 | 6.09E−41 | 4.70E−39 | GHR | 2690 |
| ENSG00000197070 | 6.40E−41 | 4.92E−39 | ARRDC1 | 92714 |
| ENSG00000137812 | 7.66E−41 | 5.87E−39 | CASC5 | 57082 |

TABLE 6-continued

| | | | | |
|---|---|---|---|---|
| ENSG00000153147 | 8.53E-41 | 6.52E-39 | SMARCA5 | 8467 |
| ENSG00000136193 | 1.10E-40 | 8.39E-39 | SCRN1 | 9805 |
| ENSG00000253352 | 1.13E-40 | 8.57E-39 | NA | NA |
| ENSG00000166073 | 1.34E-40 | 1.01E-38 | GPR176 | 11245 |
| ENSG00000237515 | 1.36E-40 | 1.02E-38 | SHISA9 | 729993 |
| ENSG00000143819 | 1.93E-40 | 1.45E-38 | EPHX1 | 2052 |
| ENSG00000127920 | 2.08E-40 | 1.55E-38 | GNG11 | 2791 |
| ENSG00000007516 | 2.10E-40 | 1.57E-38 | BAIAP3 | 8938 |
| ENSG00000178567 | 2.11E-40 | 1.57E-38 | EPM2AIP1 | 9852 |
| ENSG00000120868 | 2.34E-40 | 1.74E-38 | APAF1 | 317 |
| ENSG00000103994 | 2.37E-40 | 1.75E-38 | ZNF106 | 64397 |
| ENSG00000138119 | 2.55E-40 | 1.88E-38 | MYOF | 26509 |
| ENSG00000163214 | 2.71E-40 | 1.99E-38 | DHX57 | 90957 |
| ENSG00000154783 | 2.73E-40 | 2.00E-38 | FGD5 | 152273 |
| ENSG00000257671 | 3.59E-40 | 2.62E-38 | NA | NA |
| ENSG00000139547 | 3.73E-40 | 2.71E-38 | RDH16 | 8608 |
| ENSG00000189143 | 3.91E-40 | 2.84E-38 | CLDN4 | 1364 |
| ENSG00000196458 | 4.07E-40 | 2.94E-38 | ZNF605 | 100289635 |
| ENSG00000185043 | 4.23E-40 | 3.05E-38 | CIB1 | 10519 |
| ENSG00000205302 | 4.45E-40 | 3.20E-38 | SNX2 | 6643 |
| ENSG00000137486 | 4.55E-40 | 3.25E-38 | ARRB1 | 408 |
| ENSG00000185499 | 4.68E-40 | 3.34E-38 | MUC1 | 4582 |
| ENSG00000004838 | 5.25E-40 | 3.74E-38 | ZMYND10 | 51364 |
| ENSG00000137177 | 5.37E-40 | 3.81E-38 | KIF13A | 63971 |
| ENSG00000189180 | 8.46E-40 | 5.98E-38 | ZNF33A | 7581 |
| ENSG00000143514 | 9.12E-40 | 6.42E-38 | TP53BP2 | 7159 |
| ENSG00000112249 | 9.86E-40 | 6.92E-38 | ASCC3 | 10973 |
| ENSG00000164961 | 9.93E-40 | 6.96E-38 | KIAA0196 | 9897 |
| ENSG00000185728 | 1.01E-39 | 7.07E-38 | YTHDF3 | 253943 |
| ENSG00000158636 | 1.02E-39 | 7.07E-38 | C11orf30 | 56946 |
| ENSG00000064313 | 1.05E-39 | 7.27E-38 | TAF2 | 6873 |
| ENSG00000116991 | 1.12E-39 | 7.74E-38 | SIPA1L2 | 57568 |
| ENSG00000161813 | 1.12E-39 | 7.74E-38 | LARP4 | 113251 |
| ENSG00000172057 | 1.17E-39 | 8.03E-38 | ORMDL3 | 94103 |
| ENSG00000166106 | 1.38E-39 | 9.46E-38 | ADAMTS15 | 170689 |
| ENSG00000136937 | 1.40E-39 | 9.58E-38 | NCBP1 | 4686 |
| ENSG00000090889 | 1.46E-39 | 9.94E-38 | KIF4A | 24137 |
| ENSG00000166004 | 1.62E-39 | 1.10E-37 | CEP295 | 85459 |
| ENSG00000067836 | 1.66E-39 | 1.13E-37 | ROGDI | 79641 |
| ENSG00000160551 | 1.71E-39 | 1.16E-37 | TAOK1 | 57551 |
| ENSG00000170442 | 1.73E-39 | 1.16E-37 | KRT86 | 3892 |
| ENSG00000179295 | 1.77E-39 | 1.19E-37 | PTPN11 | 5781 |
| ENSG00000204054 | 1.81E-39 | 1.21E-37 | NA | NA |
| ENSG00000144824 | 3.72E-39 | 2.48E-37 | PHLDB2 | 90102 |
| ENSG00000116984 | 3.83E-39 | 2.55E-37 | MTR | 4548 |
| ENSG00000100596 | 4.34E-39 | 2.88E-37 | SPTLC2 | 9517 |
| ENSG00000257621 | 4.39E-39 | 2.91E-37 | PSMA3-AS1 | 379025 |
| ENSG00000168447 | 4.69E-39 | 3.09E-37 | SCNN1B | 6338 |
| ENSG00000242265 | 4.80E-39 | 3.16E-37 | PEG10 | 23089 |
| ENSG00000119906 | 5.36E-39 | 3.51E-37 | SLF2 | 55719 |
| ENSG00000079246 | 5.58E-39 | 3.65E-37 | XRCC5 | 7520 |
| ENSG00000132424 | 5.73E-39 | 3.74E-37 | PNISR | 25957 |
| ENSG00000149308 | 6.12E-39 | 3.98E-37 | NPAT | 4863 |
| ENSG00000120137 | 6.14E-39 | 3.98E-37 | PANK3 | 79646 |
| ENSG00000188559 | 8.40E-39 | 5.43E-37 | RALGAPA2 | 57186 |
| ENSG00000119285 | 8.97E-39 | 5.78E-37 | HEATR1 | 55127 |
| ENSG00000057019 | 9.70E-39 | 6.24E-37 | DCBLD2 | 131566 |
| ENSG00000115226 | 1.04E-38 | 6.70E-37 | FNDC4 | 64838 |
| ENSG00000141027 | 1.26E-38 | 8.08E-37 | NCOR1 | 9611 |
| ENSG00000110321 | 1.64E-38 | 1.04E-36 | EIF4G2 | 1982 |
| ENSG00000230551 | 1.78E-38 | 1.13E-36 | NA | NA |
| ENSG00000010278 | 2.83E-38 | 1.80E-36 | CD9 | 928 |
| ENSG00000140396 | 2.97E-38 | 1.88E-36 | NCOA2 | 10499 |
| ENSG00000115825 | 3.07E-38 | 1.94E-36 | PRKD3 | 23683 |
| ENSG00000171681 | 3.18E-38 | 2.00E-36 | ATF7IP | 55729 |
| ENSG00000115808 | 3.21E-38 | 2.02E-36 | STRN | 6801 |
| ENSG00000108840 | 3.55E-38 | 2.22E-36 | HDAC5 | 10014 |
| ENSG00000005889 | 3.74E-38 | 2.33E-36 | ZFX | 7543 |
| ENSG00000137628 | 3.92E-38 | 2.44E-36 | DDX60 | 55601 |
| ENSG00000127914 | 4.17E-38 | 2.59E-36 | AKAP9 | 10142 |
| ENSG00000168214 | 4.94E-38 | 3.06E-36 | RBPJ | 3516 |
| ENSG00000171552 | 5.30E-38 | 3.27E-36 | BCL2L1 | 598 |
| ENSG00000198826 | 5.41E-38 | 3.32E-36 | ARHGAP11A | 9824 |
| ENSG00000188994 | 5.41E-38 | 3.32E-36 | ZNF292 | 23036 |
| ENSG00000138778 | 5.59E-38 | 3.42E-36 | CENPE | 1062 |
| ENSG00000100731 | 7.48E-38 | 4.57E-36 | PCNX | 22990 |
| ENSG00000136824 | 7.59E-38 | 4.62E-36 | SMC2 | 10592 |
| ENSG00000104067 | 8.38E-38 | 5.09E-36 | TJP1 | 7082 |
| ENSG00000103653 | 8.50E-38 | 5.15E-36 | CSK | 1445 |
| ENSG00000254531 | 1.04E-37 | 6.29E-36 | FLJ20021 | 90024 |

TABLE 6-continued

| | | | | |
|---|---|---|---|---|
| ENSG00000204217 | 1.07E−37 | 6.43E−36 | BMPR2 | 659 |
| ENSG00000066279 | 1.10E−37 | 6.59E−36 | ASPM | 259266 |
| ENSG00000177666 | 1.10E−37 | 6.62E−36 | PNPLA2 | 57104 |
| ENSG00000163660 | 1.36E−37 | 8.10E−36 | CCNL1 | 57018 |
| ENSG00000118985 | 1.36E−37 | 8.10E−36 | ELL2 | 22936 |
| ENSG00000184575 | 1.48E−37 | 8.80E−36 | XPOT | 11260 |
| ENSG00000175356 | 1.57E−37 | 9.34E−36 | SCUBE2 | 57758 |
| ENSG00000123684 | 1.62E−37 | 9.60E−36 | LPGAT1 | 9926 |
| ENSG00000115159 | 1.64E−37 | 9.67E−36 | GPD2 | 2820 |
| ENSG00000142166 | 1.86E−37 | 1.09E−35 | IFNAR1 | 3454 |
| ENSG00000143878 | 2.09E−37 | 1.23E−35 | RHOB | 388 |
| ENSG00000152601 | 2.17E−37 | 1.27E−35 | MBNL1 | 4154 |
| ENSG00000159086 | 2.19E−37 | 1.28E−35 | PAXBP1 | 94104 |
| ENSG00000163939 | 2.27E−37 | 1.32E−35 | PBRM1 | 55193 |
| ENSG00000137776 | 2.36E−37 | 1.37E−35 | SLTM | 79811 |
| ENSG00000136918 | 2.64E−37 | 1.53E−35 | WDR38 | 401551 |
| ENSG00000145022 | 2.87E−37 | 1.66E−35 | TCTA | 6988 |
| ENSG00000113649 | 3.00E−37 | 1.73E−35 | TCERG1 | 10915 |
| ENSG00000103540 | 3.14E−37 | 1.80E−35 | CCP110 | 9738 |
| ENSG00000116260 | 3.16E−37 | 1.81E−35 | QSOX1 | 5768 |
| ENSG00000100815 | 3.59E−37 | 2.06E−35 | TRIP11 | 9321 |
| ENSG00000107771 | 3.96E−37 | 2.26E−35 | CCSER2 | 54462 |
| ENSG00000009413 | 4.07E−37 | 2.31E−35 | REV3L | 5980 |
| ENSG00000197879 | 4.31E−37 | 2.45E−35 | MYO1C | 4641 |
| ENSG00000074054 | 5.56E−37 | 3.15E−35 | CLASP1 | 23332 |
| ENSG00000184009 | 5.57E−37 | 3.15E−35 | ACTG1 | 71 |
| ENSG00000169026 | 6.20E−37 | 3.50E−35 | MFSD7 | 84179 |
| ENSG00000135870 | 6.96E−37 | 3.91E−35 | RC3H1 | 149041 |
| ENSG00000101040 | 7.27E−37 | 4.08E−35 | ZMYND8 | 23613 |
| ENSG00000117114 | 7.78E−37 | 4.35E−35 | ADGRL2 | 23266 |
| ENSG00000198040 | 7.86E−37 | 4.39E−35 | ZNF84 | 7637 |
| ENSG00000147050 | 8.12E−37 | 4.52E−35 | KDM6A | 7403 |
| ENSG00000102531 | 1.03E−36 | 5.73E−35 | FNDC3A | 22862 |
| ENSG00000072364 | 1.08E−36 | 5.98E−35 | AFF4 | 27125 |
| ENSG00000124664 | 1.20E−36 | 6.61E−35 | SPDEF | 25803 |
| ENSG00000180573 | 1.23E−36 | 6.79E−35 | HIST1H2AC | 8334 |
| ENSG00000147133 | 1.71E−36 | 9.38E−35 | TAF1 | 6872 |
| ENSG00000076382 | 1.73E−36 | 9.47E−35 | SPAG5 | 10615 |
| ENSG00000146938 | 1.81E−36 | 9.92E−35 | NLGN4X | 57502 |
| ENSG00000235027 | 1.83E−36 | 9.97E−35 | NA | NA |
| ENSG00000169155 | 1.86E−36 | 1.01E−34 | ZBTB43 | 23099 |
| ENSG00000188833 | 1.98E−36 | 1.08E−34 | ENTPD8 | 377841 |
| ENSG00000116704 | 2.09E−36 | 1.13E−34 | SLC35D1 | 23169 |
| ENSG00000104805 | 2.30E−36 | 1.25E−34 | NUCB1 | 4924 |
| ENSG00000029363 | 2.44E−36 | 1.32E−34 | BCLAF1 | 9774 |
| ENSG00000139116 | 2.53E−36 | 1.36E−34 | KIF21A | 55605 |
| ENSG00000070759 | 2.69E−36 | 1.45E−34 | TESK2 | 10420 |
| ENSG00000132680 | 2.71E−36 | 1.45E−34 | KIAA0907 | 22889 |
| ENSG00000038219 | 3.09E−36 | 1.65E−34 | BOD1L1 | 259282 |
| ENSG00000092439 | 3.42E−36 | 1.82E−34 | TRPM7 | 54822 |
| ENSG00000152894 | 3.55E−36 | 1.89E−34 | PTPRK | 5796 |
| ENSG00000143401 | 3.69E−36 | 1.96E−34 | ANP32E | 81611 |
| ENSG00000114331 | 3.97E−36 | 2.10E−34 | ACAP2 | 23527 |
| ENSG00000096063 | 4.23E−36 | 2.24E−34 | SRPK1 | 6732 |
| ENSG00000165215 | 4.30E−36 | 2.27E−34 | CLDN3 | 1365 |
| ENSG00000165417 | 4.40E−36 | 2.32E−34 | GTF2A1 | 2957 |
| ENSG00000171467 | 4.54E−36 | 2.38E−34 | ZNF318 | 24149 |
| ENSG00000124155 | 4.57E−36 | 2.39E−34 | PIGT | 51604 |
| ENSG00000138185 | 5.09E−36 | 2.66E−34 | ENTPD1 | 953 |
| ENSG00000163346 | 5.15E−36 | 2.69E−34 | PBXIP1 | 57326 |
| ENSG00000163762 | 5.70E−36 | 2.96E−34 | TM4SF18 | 116441 |
| ENSG00000102710 | 5.70E−36 | 2.96E−34 | SUPT20H | 55578 |
| ENSG00000074370 | 6.39E−36 | 3.31E−34 | ATP2A3 | 489 |
| ENSG00000176542 | 6.42E−36 | 3.32E−34 | KIAA2018 | 205717 |
| ENSG00000065054 | 6.46E−36 | 3.33E−34 | SLC9A3R2 | 9351 |
| ENSG00000167658 | 6.57E−36 | 3.38E−34 | EEF2 | 1938 |
| ENSG00000152223 | 7.47E−36 | 3.83E−34 | EPG5 | 57724 |
| ENSG00000102780 | 7.83E−36 | 4.01E−34 | DGKH | 160851 |
| ENSG00000150281 | 8.67E−36 | 4.43E−34 | CTF1 | 1489 |
| ENSG00000119684 | 9.16E−36 | 4.67E−34 | MLH3 | 27030 |
| ENSG00000088002 | 9.95E−36 | 5.06E−34 | SULT2B1 | 6820 |
| ENSG00000139354 | 1.07E−35 | 5.42E−34 | GAS2L3 | 283431 |
| ENSG00000203668 | 1.13E−35 | 5.74E−34 | CHML | 1122 |
| ENSG00000109046 | 1.22E−35 | 6.18E−34 | WSB1 | 26118 |
| ENSG00000133657 | 1.41E−35 | 7.10E−34 | ATP13A3 | 79572 |
| ENSG00000065328 | 1.57E−35 | 7.91E−34 | MCM10 | 55388 |
| ENSG00000261609 | 1.61E−35 | 8.10E−34 | GAN | 8139 |
| ENSG00000100994 | 1.62E−35 | 8.11E−34 | PYGB | 5834 |
| ENSG00000179403 | 1.63E−35 | 8.15E−34 | VWA1 | 64856 |
| ENSG00000249437 | 1.86E−35 | 9.29E−34 | NAIP | 4671 |

TABLE 6-continued

| | | | | |
|---|---|---|---|---|
| ENSG00000137804 | 2.13E-35 | 1.06E-33 | NUSAP1 | 51203 |
| ENSG00000101596 | 2.51E-35 | 1.24E-33 | SMCHD1 | 23347 |
| ENSG00000225830 | 2.53E-35 | 1.25E-33 | ERCC6 | 2074 |
| ENSG00000012983 | 2.60E-35 | 1.29E-33 | MAP4K5 | 11183 |
| ENSG00000155366 | 2.94E-35 | 1.45E-33 | RHOC | 389 |
| ENSG00000077097 | 3.06E-35 | 1.51E-33 | TOP2B | 7155 |
| ENSG00000106692 | 3.54E-35 | 1.74E-33 | FKTN | 2218 |
| ENSG00000117984 | 3.80E-35 | 1.86E-33 | CTSD | 1509 |
| ENSG00000137710 | 4.10E-35 | 2.01E-33 | RDX | 5962 |
| ENSG00000143761 | 4.39E-35 | 2.14E-33 | ARF1 | 375 |
| ENSG00000198355 | 4.41E-35 | 2.15E-33 | PIM3 | 415116 |
| ENSG00000111300 | 4.55E-35 | 2.21E-33 | NAA25 | 80018 |
| ENSG00000215301 | 4.73E-35 | 2.29E-33 | DDX3X | 1654 |
| ENSG00000215845 | 4.99E-35 | 2.42E-33 | TSTD1 | 100131187 |
| ENSG00000048028 | 5.14E-35 | 2.48E-33 | USP28 | 57646 |
| ENSG00000110092 | 5.32E-35 | 2.56E-33 | CCND1 | 595 |
| ENSG00000186577 | 5.38E-35 | 2.59E-33 | C6orf1 | 221491 |
| ENSG00000124243 | 5.39E-35 | 2.59E-33 | BCAS4 | 55653 |
| ENSG00000117139 | 5.53E-35 | 2.64E-33 | KDM5B | 10765 |
| ENSG00000162004 | 5.61E-35 | 2.68E-33 | CCDC78 | 124093 |
| ENSG00000111961 | 5.64E-35 | 2.69E-33 | SASH1 | 23328 |
| ENSG00000169855 | 6.21E-35 | 2.95E-33 | ROBO1 | 6091 |
| ENSG00000183888 | 7.11E-35 | 3.38E-33 | C1orf64 | 149563 |
| ENSG00000264558 | 7.57E-35 | 3.58E-33 | NA | NA |
| ENSG00000124795 | 7.62E-35 | 3.60E-33 | DEK | 7913 |
| ENSG00000166557 | 7.70E-35 | 3.63E-33 | TMED3 | 23423 |
| ENSG00000129654 | 7.87E-35 | 3.71E-33 | FOXJ1 | 2302 |
| ENSG00000140525 | 7.95E-35 | 3.74E-33 | FANCI | 55215 |
| ENSG00000123473 | 8.15E-35 | 3.82E-33 | STIL | 6491 |
| ENSG00000108786 | 8.30E-35 | 3.88E-33 | HSD17B1 | 3292 |
| ENSG00000141522 | 8.51E-35 | 3.97E-33 | ARHGDIA | 396 |
| ENSG00000125686 | 8.75E-35 | 4.07E-33 | MED1 | 5469 |
| ENSG00000100201 | 1.12E-34 | 5.19E-33 | DDX17 | 10521 |
| ENSG00000185624 | 1.14E-34 | 5.29E-33 | P4HB | 5034 |
| ENSG00000120327 | 1.15E-34 | 5.31E-33 | PCDHB14 | 56122 |
| ENSG00000175137 | 1.16E-34 | 5.35E-33 | SH3BP5L | 80851 |
| ENSG00000124789 | 1.20E-34 | 5.56E-33 | NUP153 | 9972 |
| ENSG00000197746 | 1.24E-34 | 5.71E-33 | PSAP | 5660 |
| ENSG00000169692 | 1.31E-34 | 6.03E-33 | AGPAT2 | 10555 |
| ENSG00000141736 | 1.37E-34 | 6.30E-33 | ERBB2 | 2064 |
| ENSG00000167797 | 1.38E-34 | 6.33E-33 | CDK2AP2 | 10263 |
| ENSG00000164151 | 1.41E-34 | 6.43E-33 | ICE1 | 23379 |
| ENSG00000178814 | 1.46E-34 | 6.67E-33 | OPLAH | 26873 |
| ENSG00000174080 | 1.49E-34 | 6.76E-33 | CTSF | 8722 |
| ENSG00000166828 | 1.59E-34 | 7.20E-33 | SCNN1G | 6340 |
| ENSG00000156970 | 1.66E-34 | 7.53E-33 | BUB1B | 701 |
| ENSG00000100485 | 1.71E-34 | 7.74E-33 | SOS2 | 6655 |
| ENSG00000130779 | 1.85E-34 | 8.37E-33 | CLIP1 | 6249 |
| ENSG00000171302 | 2.18E-34 | 9.81E-33 | CANT1 | 124583 |
| ENSG00000076003 | 2.20E-34 | 9.86E-33 | MCM6 | 4175 |
| ENSG00000164134 | 2.20E-34 | 9.86E-33 | NA | NA |
| ENSG00000213186 | 2.55E-34 | 1.14E-32 | TRIM59 | 286827 |
| ENSG00000196247 | 2.55E-34 | 1.14E-32 | ZNF107 | 51427 |
| ENSG00000138496 | 2.73E-34 | 1.22E-32 | PARP9 | 83666 |
| ENSG00000107521 | 2.74E-34 | 1.22E-32 | HPS1 | 3257 |
| ENSG00000198369 | 2.80E-34 | 1.25E-32 | SPRED2 | 200734 |
| ENSG00000157741 | 3.27E-34 | 1.45E-32 | UBN2 | 254048 |
| ENSG00000111670 | 3.45E-34 | 1.52E-32 | GNPTAB | 79158 |
| ENSG00000116285 | 3.92E-34 | 1.73E-32 | ERRFI1 | 54206 |
| ENSG00000233622 | 3.94E-34 | 1.74E-32 | NA | NA |
| ENSG00000178057 | 3.96E-34 | 1.74E-32 | NDUFAF3 | 25915 |
| ENSG00000186660 | 4.24E-34 | 1.86E-32 | ZFP91 | 80829 |
| ENSG00000061987 | 5.08E-34 | 2.23E-32 | MON2 | 23041 |
| ENSG00000225138 | 5.11E-34 | 2.23E-32 | NA | NA |
| ENSG00000198146 | 5.28E-34 | 2.30E-32 | ZNF770 | 54989 |
| ENSG00000153250 | 5.34E-34 | 2.32E-32 | RBMS1 | 5937 |
| ENSG00000105518 | 5.34E-34 | 2.32E-32 | TMEM205 | 374882 |
| ENSG00000197982 | 5.82E-34 | 2.53E-32 | C1orf122 | 127687 |
| ENSG00000169398 | 6.55E-34 | 2.84E-32 | PTK2 | 5747 |
| ENSG00000174373 | 6.65E-34 | 2.87E-32 | RALGAPA1 | 253959 |
| ENSG00000135929 | 7.01E-34 | 3.02E-32 | CYP27A1 | 1593 |
| ENSG00000123983 | 7.08E-34 | 3.05E-32 | ACSL3 | 2181 |
| ENSG00000135821 | 7.93E-34 | 3.41E-32 | GLUL | 2752 |
| ENSG00000105289 | 8.78E-34 | 3.77E-32 | TJP3 | 27134 |
| ENSG00000108506 | 1.05E-33 | 4.49E-32 | INTS2 | 57508 |
| ENSG00000149809 | 1.10E-33 | 4.72E-32 | TM7SF2 | 7108 |
| ENSG00000266962 | 1.15E-33 | 4.90E-32 | NA | NA |
| ENSG00000130193 | 1.16E-33 | 4.94E-32 | THEM6 | 51337 |
| ENSG00000168411 | 1.21E-33 | 5.13E-32 | RFWD3 | 55159 |
| ENSG00000198730 | 1.31E-33 | 5.56E-32 | CTR9 | 9646 |

TABLE 6-continued

| | | | | |
|---|---|---|---|---|
| ENSG00000151090 | 1.37E-33 | 5.82E-32 | THRB | 7068 |
| ENSG00000083168 | 1.40E-33 | 5.93E-32 | KAT6A | 7994 |
| ENSG00000257181 | 1.44E-33 | 6.07E-32 | NA | NA |
| ENSG00000135272 | 1.53E-33 | 6.45E-32 | MDFIC | 29969 |
| ENSG00000157625 | 1.60E-33 | 6.72E-32 | TAB3 | 257397 |
| ENSG00000196963 | 1.68E-33 | 7.05E-32 | NA | NA |
| ENSG00000245156 | 1.68E-33 | 7.05E-32 | NA | NA |
| ENSG00000171295 | 1.83E-33 | 7.64E-32 | ZNF440 | 126070 |
| ENSG00000165140 | 1.90E-33 | 7.94E-32 | FBP1 | 2203 |
| ENSG00000166439 | 1.93E-33 | 8.05E-32 | RNF169 | 254225 |
| ENSG00000083845 | 1.99E-33 | 8.26E-32 | RPS5 | 6193 |
| ENSG00000179627 | 2.01E-33 | 8.34E-32 | ZBTB42 | 100128927 |
| ENSG00000137801 | 2.05E-33 | 8.50E-32 | THBS1 | 7057 |
| ENSG00000137941 | 2.07E-33 | 8.54E-32 | TTLL7 | 79739 |
| ENSG00000121957 | 2.31E-33 | 9.55E-32 | GPSM2 | 29899 |
| ENSG00000167258 | 2.32E-33 | 9.55E-32 | CDK12 | 51755 |
| ENSG00000176978 | 2.36E-33 | 9.71E-32 | DPP7 | 29952 |
| ENSG00000180530 | 2.41E-33 | 9.90E-32 | NRIP1 | 8204 |
| ENSG00000163755 | 2.49E-33 | 1.02E-31 | HPS3 | 84343 |
| ENSG00000096060 | 2.96E-33 | 1.21E-31 | FKBP5 | 2289 |
| ENSG00000143776 | 3.02E-33 | 1.23E-31 | CDC42BPA | 8476 |
| ENSG00000130529 | 3.13E-33 | 1.28E-31 | TRPM4 | 54795 |
| ENSG00000135341 | 3.55E-33 | 1.44E-31 | MAP3K7 | 6885 |
| ENSG00000163961 | 3.62E-33 | 1.47E-31 | RNF168 | 165918 |
| ENSG00000173905 | 4.03E-33 | 1.63E-31 | GOLIM4 | 27333 |
| ENSG00000261183 | 4.18E-33 | 1.69E-31 | LOC102724362 | 102724362 |
| ENSG00000125633 | 4.78E-33 | 1.93E-31 | CCDC93 | 54520 |
| ENSG00000204308 | 4.86E-33 | 1.96E-31 | RNF5 | 6048 |
| ENSG00000083896 | 5.12E-33 | 2.06E-31 | YTHDC1 | 91746 |
| ENSG00000121741 | 5.31E-33 | 2.13E-31 | ZMYM2 | 7750 |
| ENSG00000151693 | 5.66E-33 | 2.27E-31 | ASAP2 | 8853 |
| ENSG00000182584 | 6.05E-33 | 2.42E-31 | ACTL10 | 170487 |
| ENSG00000170266 | 6.16E-33 | 2.46E-31 | GLB1 | 2720 |
| ENSG00000135924 | 6.17E-33 | 2.46E-31 | DNAJB2 | 3300 |
| ENSG00000143367 | 6.42E-33 | 2.56E-31 | TUFT1 | 7286 |
| ENSG00000174371 | 6.44E-33 | 2.56E-31 | EXO1 | 9156 |
| ENSG00000125534 | 6.70E-33 | 2.66E-31 | PPDPF | 79144 |
| ENSG00000011114 | 6.72E-33 | 2.66E-31 | BTBD7 | 55727 |
| ENSG00000149418 | 6.97E-33 | 2.76E-31 | ST14 | 6768 |
| ENSG00000046604 | 7.17E-33 | 2.83E-31 | DSG2 | 1829 |
| ENSG00000106780 | 7.66E-33 | 3.02E-31 | MEGF9 | 1955 |
| ENSG00000168350 | 7.80E-33 | 3.07E-31 | DEGS2 | 123099 |
| ENSG00000106415 | 8.37E-33 | 3.29E-31 | GLCCI1 | 113263 |
| ENSG00000175455 | 8.63E-33 | 3.39E-31 | CCDC14 | 64770 |
| ENSG00000198420 | 8.77E-33 | 3.44E-31 | TCAF1 | 9747 |
| ENSG00000124177 | 9.76E-33 | 3.81E-31 | CHD6 | 84181 |
| ENSG00000010818 | 9.82E-33 | 3.83E-31 | HIVEP2 | 3097 |
| ENSG00000149311 | 9.89E-33 | 3.85E-31 | ATM | 472 |
| ENSG00000172939 | 1.01E-32 | 3.91E-31 | OXSR1 | 9943 |
| ENSG00000197535 | 1.07E-32 | 4.14E-31 | MYO5A | 4644 |
| ENSG00000114790 | 1.08E-32 | 4.17E-31 | ARHGEF26 | 26084 |
| ENSG00000055208 | 1.19E-32 | 4.61E-31 | TAB2 | 23118 |
| ENSG00000167703 | 1.21E-32 | 4.67E-31 | SLC43A2 | 124935 |
| ENSG00000122966 | 1.22E-32 | 4.70E-31 | CIT | 11113 |
| ENSG00000137075 | 1.37E-32 | 5.27E-31 | RNF38 | 152006 |
| ENSG00000079999 | 1.38E-32 | 5.30E-31 | KEAP1 | 9817 |
| ENSG00000198483 | 1.44E-32 | 5.53E-31 | ANKRD35 | 148741 |
| ENSG00000104904 | 1.45E-32 | 5.56E-31 | OAZ1 | 4946 |
| ENSG00000171148 | 1.48E-32 | 5.67E-31 | TADA3 | 10474 |
| ENSG00000129951 | 1.53E-32 | 5.83E-31 | LPPR3 | 79948 |
| ENSG00000198315 | 1.59E-32 | 6.04E-31 | ZKSCAN8 | 7745 |
| ENSG00000073711 | 1.70E-32 | 6.48E-31 | PPP2R3A | 5523 |
| ENSG00000146540 | 1.82E-32 | 6.93E-31 | C7orf50 | 84310 |
| ENSG00000040731 | 1.85E-32 | 7.02E-31 | CDH10 | 1008 |
| ENSG00000138802 | 1.87E-32 | 7.10E-31 | SEC24B | 10427 |
| ENSG00000120008 | 1.91E-32 | 7.21E-31 | WDR11 | 55717 |
| ENSG00000262413 | 1.94E-32 | 7.31E-31 | NA | NA |
| ENSG00000107581 | 1.95E-32 | 7.34E-31 | EIF3A | 8661 |
| ENSG00000114805 | 1.96E-32 | 7.39E-31 | PLCH1 | 23007 |
| ENSG00000162496 | 2.00E-32 | 7.52E-31 | DHRS3 | 9249 |
| ENSG00000079387 | 2.16E-32 | 8.09E-31 | SENP1 | 29843 |
| ENSG00000185303 | 2.17E-32 | 8.13E-31 | SFTPA2 | 729238 |
| ENSG00000100321 | 2.23E-32 | 8.34E-31 | SYNGR1 | 9145 |
| ENSG00000134318 | 2.60E-32 | 9.68E-31 | ROCK2 | 9475 |
| ENSG00000115649 | 2.60E-32 | 9.68E-31 | CNPPD1 | 27013 |
| ENSG00000147548 | 2.70E-32 | 1.00E-30 | WHSC1L1 | 54904 |
| ENSG00000151491 | 2.85E-32 | 1.06E-30 | EPS8 | 2059 |
| ENSG00000113522 | 2.91E-32 | 1.08E-30 | RAD50 | 10111 |
| ENSG00000157540 | 2.94E-32 | 1.09E-30 | DYRK1A | 1859 |
| ENSG00000002834 | 3.17E-32 | 1.17E-30 | LASP1 | 3927 |

TABLE 6-continued

| | | | | |
|---|---|---|---|---|
| ENSG00000133313 | 3.30E-32 | 1.22E-30 | CNDP2 | 55748 |
| ENSG00000134644 | 3.67E-32 | 1.35E-30 | PUM1 | 9698 |
| ENSG00000206530 | 4.02E-32 | 1.48E-30 | CFAP44 | 55779 |
| ENSG00000134744 | 4.16E-32 | 1.53E-30 | ZCCHC11 | 23318 |
| ENSG00000130338 | 4.19E-32 | 1.54E-30 | TULP4 | 56995 |
| ENSG00000085831 | 4.20E-32 | 1.54E-30 | TTC39A | 22996 |
| ENSG00000179085 | 4.25E-32 | 1.55E-30 | DPM3 | 54344 |
| ENSG00000074657 | 4.35E-32 | 1.58E-30 | ZNF532 | 55205 |
| ENSG00000172830 | 4.35E-32 | 1.58E-30 | SSH3 | 54961 |
| ENSG00000168140 | 5.66E-32 | 2.06E-30 | VASN | 114990 |
| ENSG00000118412 | 5.74E-32 | 2.08E-30 | CASP8AP2 | 9994 |
| ENSG00000122971 | 5.79E-32 | 2.10E-30 | ACADS | 35 |
| ENSG00000011258 | 5.89E-32 | 2.13E-30 | MBTD1 | 54799 |
| ENSG00000196670 | 6.30E-32 | 2.28E-30 | ZFP62 | 643836 |
| ENSG00000133858 | 6.48E-32 | 2.34E-30 | ZFC3H1 | 196441 |
| ENSG00000196408 | 7.13E-32 | 2.57E-30 | NOXO1 | 124056 |
| ENSG00000128833 | 7.67E-32 | 2.76E-30 | MYO5C | 55930 |
| ENSG00000123104 | 7.81E-32 | 2.80E-30 | ITPR2 | 3709 |
| ENSG00000051341 | 8.08E-32 | 2.90E-30 | POLQ | 10721 |
| ENSG00000171241 | 8.84E-32 | 3.16E-30 | SHCBP1 | 79801 |
| ENSG00000260822 | 9.16E-32 | 3.27E-30 | NA | NA |
| ENSG00000143924 | 9.32E-32 | 3.33E-30 | EML4 | 27436 |
| ENSG00000109805 | 9.39E-32 | 3.34E-30 | NCAPG | 64151 |
| ENSG00000125744 | 9.51E-32 | 3.38E-30 | RTN2 | 6253 |
| ENSG00000171813 | 9.80E-32 | 3.48E-30 | PWWP2B | 170394 |
| ENSG00000078902 | 1.04E-31 | 3.69E-30 | TOLLIP | 54472 |
| ENSG00000116406 | 1.04E-31 | 3.69E-30 | EDEM3 | 80267 |
| ENSG00000143322 | 1.16E-31 | 4.12E-30 | ABL2 | 27 |
| ENSG00000161011 | 1.19E-31 | 4.19E-30 | SQSTM1 | 8878 |
| ENSG00000111057 | 1.25E-31 | 4.42E-30 | KRT18 | 3875 |
| ENSG00000176845 | 1.27E-31 | 4.46E-30 | METRNL | 284207 |
| ENSG00000103657 | 1.28E-31 | 4.49E-30 | HERC1 | 8925 |
| ENSG00000073921 | 1.34E-31 | 4.70E-30 | PICALM | 8301 |
| ENSG00000128585 | 1.37E-31 | 4.79E-30 | MKLN1 | 4289 |
| ENSG00000173212 | 1.38E-31 | 4.84E-30 | MAB21L3 | 126868 |
| ENSG00000170949 | 1.41E-31 | 4.93E-30 | ZNF160 | 90338 |
| ENSG00000143970 | 1.47E-31 | 5.11E-30 | ASXL2 | 55252 |
| ENSG00000163808 | 1.62E-31 | 5.65E-30 | KIF15 | 56992 |
| ENSG00000101639 | 1.85E-31 | 6.42E-30 | CEP192 | 55125 |
| ENSG00000107281 | 1.88E-31 | 6.52E-30 | NPDC1 | 56654 |
| ENSG00000255108 | 1.93E-31 | 6.70E-30 | NA | NA |
| ENSG00000149932 | 2.13E-31 | 7.36E-30 | TMEM219 | 124446 |
| ENSG00000110318 | 2.14E-31 | 7.40E-30 | CEP126 | 57562 |
| ENSG00000111145 | 2.42E-31 | 8.33E-30 | ELK3 | 2004 |
| ENSG00000177311 | 2.59E-31 | 8.93E-30 | ZBTB38 | 253461 |
| ENSG00000115904 | 2.61E-31 | 8.98E-30 | SOS1 | 6654 |
| ENSG00000158109 | 2.69E-31 | 9.24E-30 | TPRG1L | 127262 |
| ENSG00000075391 | 2.77E-31 | 9.50E-30 | RASAL2 | 9462 |
| ENSG00000184939 | 2.88E-31 | 9.87E-30 | ZFP90 | 146198 |
| ENSG00000167778 | 3.14E-31 | 1.07E-29 | SPRYD3 | 84926 |
| ENSG00000172493 | 3.17E-31 | 1.08E-29 | AFF1 | 4299 |
| ENSG00000100354 | 3.20E-31 | 1.09E-29 | TNRC6B | 23112 |
| ENSG00000235863 | 3.41E-31 | 1.16E-29 | B3GALT4 | 8705 |
| ENSG00000141298 | 3.54E-31 | 1.20E-29 | SSH2 | 85464 |
| ENSG00000164164 | 3.56E-31 | 1.21E-29 | OTUD4 | 54726 |
| ENSG00000162734 | 3.89E-31 | 1.32E-29 | PEA15 | 8682 |
| ENSG00000182809 | 3.90E-31 | 1.32E-29 | CRIP2 | 1397 |
| ENSG00000162817 | 4.60E-31 | 1356E-29 | C1orf115 | 79762 |
| ENSG00000158246 | 4.63E-31 | 1.56E-29 | FAM46B | 115572 |
| ENSG00000123933 | 4.82E-31 | 1.62E-29 | MXD4 | 10608 |
| ENSG00000146648 | 4.94E-31 | 1.66E-29 | EGFR | 1956 |
| ENSG00000172602 | 5.52E-31 | 1.85E-29 | RND1 | 27289 |
| ENSG00000170921 | 5.75E-31 | 1.93E-29 | TANC2 | 26115 |
| ENSG00000198231 | 5.91E-31 | 1.98E-29 | DDX42 | 11325 |
| ENSG00000008294 | 5.94E-31 | 1.98E-29 | SPAG9 | 9043 |
| ENSG00000197555 | 6.24E-31 | 2.08E-29 | SIPA1L1 | 26037 |
| ENSG00000127663 | 6.38E-31 | 2.13E-29 | KDM4B | 23030 |
| ENSG00000197321 | 6.46E-31 | 2.15E-29 | SVIL | 6840 |
| ENSG00000172795 | 7.09E-31 | 2.36E-29 | DCP2 | 167227 |
| ENSG00000090060 | 7.31E-31 | 2.43E-29 | PAPOLA | 10914 |
| ENSG00000233078 | 7.50E-31 | 2.49E-29 | NA | NA |
| ENSG00000107821 | 8.24E-31 | 2.73E-29 | KAZALD1 | 81621 |
| ENSG00000174903 | 8.50E-31 | 2.81E-29 | NA | NA |
| ENSG00000196693 | 8.76E-31 | 2.89E-29 | ZNF33B | 7582 |
| ENSG00000139722 | 9.03E-31 | 2.97E-29 | VPS37B | 79720 |
| ENSG00000109501 | 9.37E-31 | 3.08E-29 | WFS1 | 7466 |
| ENSG00000169189 | 9.37E-31 | 3.08E-29 | NSMCE1 | 197370 |
| ENSG00000094804 | 9.83E-31 | 3.22E-29 | CDC6 | 990 |
| ENSG00000156273 | 1.01E-30 | 3.31E-29 | NA | NA |
| ENSG00000135404 | 1.04E-30 | 3.40E-29 | CD63 | 967 |

TABLE 6-continued

| | | | | |
|---|---|---|---|---|
| ENSG00000119397 | 1.10E−30 | 3.59E−29 | CNTRL | 11064 |
| ENSG00000269987 | 1.10E−30 | 3.60E−29 | NA | NA |
| ENSG00000196924 | 1.19E−30 | 3.86E−29 | FLNA | 2316 |
| ENSG00000174718 | 1.22E−30 | 3.97E−29 | KIAA1551 | 55196 |
| ENSG00000166483 | 1.34E−30 | 4.35E−29 | WEE1 | 7465 |
| ENSG00000070882 | 1.35E−30 | 4.37E−29 | OSBPL3 | 26031 |
| ENSG00000068489 | 1.36E−30 | 4.41E−29 | PRR11 | 55771 |
| ENSG00000119912 | 1.38E−30 | 4.46E−29 | IDE | 3416 |
| ENSG00000107201 | 1.41E−30 | 4.55E−29 | DDX58 | 23586 |
| ENSG00000272565 | 1.44E−30 | 4.64E−29 | NA | NA |
| ENSG00000268313 | 1.48E−30 | 4.76E−29 | NA | NA |
| ENSG00000153187 | 1.53E−30 | 4.93E−29 | HNRNPU | 3192 |
| ENSG00000126247 | 1.61E−30 | 5.18E−29 | CAPNS1 | 826 |
| ENSG00000136492 | 1.67E−30 | 5.36E−29 | BRIP1 | 83990 |
| ENSG00000121653 | 1.68E−30 | 5.40E−29 | MAPK8IP1 | 9479 |
| ENSG00000143493 | 1.92E−30 | 6.14E−29 | INTS7 | 25896 |
| ENSG00000197043 | 1.97E−30 | 6.30E−29 | ANXA6 | 309 |
| ENSG00000166197 | 2.03E−30 | 6.49E−29 | NOLC1 | 9221 |
| ENSG00000153531 | 2.08E−30 | 6.64E−29 | ADPRHL1 | 113622 |
| ENSG00000198887 | 2.14E−30 | 6.81E−29 | SMC5 | 23137 |
| ENSG00000181827 | 2.17E−30 | 6.90E−29 | RFX7 | 64864 |
| ENSG00000162755 | 2.27E−30 | 7.20E−29 | KLHDC9 | 126823 |
| ENSG00000271430 | 2.30E−30 | 7.27E−29 | NA | NA |
| ENSG00000126005 | 2.41E−30 | 7.63E−29 | NA | NA |
| ENSG00000085644 | 2.73E−30 | 8.62E−29 | ZNF213 | 7760 |
| ENSG00000033800 | 3.05E−30 | 9.60E−29 | PIAS1 | 8554 |
| ENSG00000110723 | 3.18E−30 | 1.00E−28 | EXPH5 | 23086 |
| ENSG00000166432 | 3.31E−30 | 1.04E−28 | ZMAT1 | 84460 |
| ENSG00000126653 | 3.35E−30 | 1.05E−28 | NSRP1 | 84081 |
| ENSG00000065526 | 3.39E−30 | 1.06E−28 | SPEN | 23013 |
| ENSG00000099330 | 3.54E−30 | 1.11E−28 | OCEL1 | 79629 |
| ENSG00000104093 | 3.61E−30 | 1.13E−28 | DMXL2 | 23312 |
| ENSG00000179632 | 3.91E−30 | 1.22E−28 | MAF1 | 84232 |
| ENSG00000005483 | 3.96E−30 | 1.24E−28 | KMT2E | 55904 |
| ENSG00000140181 | 4.43E−30 | 1.38E−28 | NA | NA |
| ENSG00000139746 | 4.44E−30 | 1.38E−28 | RBM26 | 64062 |
| ENSG00000161395 | 5.37E−30 | 1.67E−28 | PGAP3 | 93210 |
| ENSG00000196517 | 5.51E−30 | 1.71E−28 | SLC6A9 | 6536 |
| ENSG00000075420 | 5.52E−30 | 1.71E−28 | FNDC3B | 64778 |
| ENSG00000150054 | 5.72E−30 | 1.77E−28 | MPP7 | 143098 |
| ENSG00000137145 | 5.79E−30 | 1.79E−28 | DENND4C | 55667 |
| ENSG00000185909 | 5.90E−30 | 1.82E−28 | KLHDC8B | 200942 |
| ENSG00000181449 | 6.68E−30 | 2.06E−28 | SOX2 | 6657 |
| ENSG00000163257 | 6.91E−30 | 2.13E−28 | DCAF16 | 54876 |
| ENSG00000174938 | 6.96E−30 | 2.14E−28 | SEZ6L2 | 26470 |
| ENSG00000185924 | 7.81E−30 | 2.40E−28 | RTN4RL1 | 146760 |
| ENSG00000050405 | 8.06E−30 | 2.47E−28 | LIMA1 | 51474 |
| ENSG00000225410 | 8.37E−30 | 2.56E−28 | NA | NA |
| ENSG00000182621 | 8.58E−30 | 2.62E−28 | PLCB1 | 23236 |
| ENSG00000123066 | 9.05E−30 | 2.76E−28 | MED13L | 23389 |
| ENSG00000163629 | 1.02E−29 | 3.09E−28 | PTPN13 | 5783 |
| ENSG00000023516 | 1.10E−29 | 3.34E−28 | AKAP11 | 11215 |
| ENSG00000143442 | 1.13E−29 | 3.42E−28 | POGZ | 23126 |
| ENSG00000176208 | 1.16E−29 | 3.52E−28 | ATAD5 | 79915 |
| ENSG00000118482 | 1.21E−29 | 3.67E−28 | PHF3 | 23469 |
| ENSG00000107262 | 1.36E−29 | 4.12E−28 | BAG1 | 573 |
| ENSG00000120458 | 1.58E−29 | 4.77E−28 | MSANTD2 | 79684 |
| ENSG00000159147 | 1.65E−29 | 4.98E−28 | DONSON | 29980 |
| ENSG00000142864 | 1.66E−29 | 5.02E−28 | SERBP1 | 26135 |
| ENSG00000244187 | 1.71E−29 | 5.15E−28 | TMEM141 | 85014 |
| ENSG00000121900 | 1.77E−29 | 5.33E−28 | TMEM54 | 113452 |
| ENSG00000165209 | 2.01E−29 | 6.05E−28 | STRBP | 55342 |
| ENSG00000082701 | 2.30E−29 | 6.90E−28 | GSK3B | 2932 |
| ENSG00000117362 | 2.37E−29 | 7.11E−28 | APH1A | 51107 |
| ENSG00000196323 | 2.42E−29 | 7.25E−28 | ZBTB44 | 29068 |
| ENSG00000164307 | 2.43E−29 | 7.27E−28 | ERAP1 | 51752 |
| ENSG00000204389 | 2.44E−29 | 7.27E−28 | HSPA1A | 3303 |
| ENSG00000177628 | 2.52E−29 | 7.50E−28 | GBA | 2629 |
| ENSG00000140264 | 2.52E−29 | 7.50E−28 | NA | NA |
| ENSG00000080200 | 2.58E−29 | 7.67E−28 | CRYBG3 | 131544 |
| ENSG00000167741 | 2.63E−29 | 7.81E−28 | GGT6 | 124975 |
| ENSG00000169118 | 2.66E−29 | 7.90E−28 | CSNK1G1 | 53944 |
| ENSG00000168137 | 2.70E−29 | 7.99E−28 | SETD5 | 55209 |
| ENSG00000166024 | 2.79E−29 | 8.26E−28 | R3HCC1L | 27291 |
| ENSG00000132300 | 2.98E−29 | 8.81E−28 | PTCD3 | 55037 |
| ENSG00000023191 | 3.13E−29 | 9.22E−28 | RNH1 | 6050 |
| ENSG00000048828 | 3.13E−29 | 9.22E−28 | FAM120A | 23196 |
| ENSG00000154760 | 3.28E−29 | 9.65E−28 | SLFN13 | 146857 |
| ENSG00000177200 | 3.33E−29 | 9.78E−28 | CHD9 | 80205 |
| ENSG00000183354 | 3.60E−29 | 1.06E−27 | KIAA2026 | 158358 |

TABLE 6-continued

| | | | | |
|---|---|---|---|---|
| ENSG00000165891 | 3.62E−29 | 1.06E−27 | E2F7 | 144455 |
| ENSG00000179195 | 3.70E−29 | 1.08E−27 | ZNF664 | 144348 |
| ENSG00000101152 | 3.77E−29 | 1.10E−27 | DNAJC5 | 80331 |
| ENSG00000234616 | 3.88E−29 | 1.13E−27 | JRK | 8629 |
| ENSG00000185697 | 3.98E−29 | 1.16E−27 | MYBL1 | 4603 |
| ENSG00000121940 | 4.01E−29 | 1.17E−27 | CLCC1 | 23155 |
| ENSG00000262831 | 4.58E−29 | 1.33E−27 | NA | NA |
| ENSG00000109062 | 4.66E−29 | 1.36E−27 | SLC9A3R1 | 9368 |
| ENSG00000108588 | 4.75E−29 | 1.38E−27 | CCDC47 | 57003 |
| ENSG00000012822 | 4.77E−29 | 1.38E−27 | CALCOCO1 | 57658 |
| ENSG00000170471 | 5.33E−29 | 1.54E−27 | RALGAPB | 57148 |
| ENSG00000089916 | 5.40E−29 | 1.56E−27 | GPATCH2L | 55668 |
| ENSG00000159082 | 5.58E−29 | 1.61E−27 | SYNJ1 | 8867 |
| ENSG00000146463 | 5.60E−29 | 1.61E−27 | ZMYM4 | 9202 |
| ENSG00000171130 | 5.62E−29 | 1.62E−27 | ATP6V0E2 | 155066 |
| ENSG00000205765 | 5.70E−29 | 1.64E−27 | C5orf51 | 285636 |
| ENSG00000172375 | 5.74E−29 | 1.65E−27 | C2CD2L | 9854 |
| ENSG00000167986 | 5.78E−29 | 1.66E−27 | DDB1 | 1642 |
| ENSG00000166783 | 5.78E−29 | 1.66E−27 | KIAA0430 | 9665 |
| ENSG00000116830 | 5.86E−29 | 1.68E−27 | TTF2 | 8458 |
| ENSG00000169604 | 6.01E−29 | 1.72E−27 | ANTXR1 | 84168 |
| ENSG00000175482 | 6.64E−29 | 1.90E−27 | POLD4 | 57804 |
| ENSG00000197562 | 6.84E−29 | 1.95E−27 | RAB40C | 57799 |
| ENSG00000132842 | 7.14E−29 | 2.03E−27 | AP3B1 | 8546 |
| ENSG00000168813 | 7.40E−29 | 2.10E−27 | ZNF507 | 22847 |
| ENSG00000104177 | 7.58E−29 | 2.15E−27 | MYEF2 | 50804 |
| ENSG00000106571 | 8.52E−29 | 2.42E−27 | GLI3 | 2737 |
| ENSG00000089220 | 8.66E−29 | 2.45E−27 | PEBP1 | 5037 |
| ENSG00000168672 | 8.74E−29 | 2.47E−27 | FAM84B | 157638 |
| ENSG00000135048 | 8.79E−29 | 2.48E−27 | TMEM2 | 23670 |
| ENSG00000140688 | 8.83E−29 | 2.49E−27 | C16orf58 | 64755 |
| ENSG00000116497 | 8.89E−29 | 2.51E−27 | S100PBP | 64766 |
| ENSG00000099849 | 9.99E−29 | 2.81E−27 | RASSF7 | 8045 |
| ENSG00000001629 | 1.03E−28 | 2.91E−27 | ANKIB1 | 54467 |
| ENSG00000186260 | 1.07E−28 | 2.99E−27 | MKL2 | 57496 |
| ENSG00000126787 | 1.12E−28 | 3.14E−27 | DLGAP5 | 9787 |
| ENSG00000072778 | 1.12E−28 | 3.15E−27 | ACADVL | 37 |
| ENSG00000176473 | 1.14E−28 | 3.18E−27 | WDR25 | 79446 |
| ENSG00000121064 | 1.19E−28 | 3.32E−27 | SCPEP1 | 59342 |
| ENSG00000114439 | 1.22E−28 | 3.39E−27 | BBX | 56987 |
| ENSG00000167552 | 1.22E−28 | 3.40E−27 | TUBA1A | 7846 |
| ENSG00000024526 | 1.28E−28 | 3.56E−27 | DEPDC1 | 55635 |
| ENSG00000042493 | 1.29E−28 | 3.60E−27 | CAPG | 822 |
| ENSG00000130513 | 1.40E−28 | 3.88E−27 | GDF15 | 9518 |
| ENSG00000121858 | 1.45E−28 | 4.03E−27 | TNFSF10 | 8743 |
| ENSG00000204130 | 1.46E−28 | 4.05E−27 | RUFY2 | 55680 |
| ENSG00000132376 | 1.51E−28 | 4.18E−27 | INPP5K | 51763 |
| ENSG00000087074 | 1.52E−28 | 4.21E−27 | PPP1R15A | 23645 |
| ENSG00000118762 | 1.71E−28 | 4.72E−27 | PKD2 | 5311 |
| ENSG00000198832 | 1.77E−28 | 4.87E−27 | SELM | 140606 |
| ENSG00000137992 | 1.79E−28 | 4.94E−27 | DBT | 1629 |
| ENSG00000166140 | 1.81E−28 | 4.98E−27 | ZFYVE19 | 84936 |
| ENSG00000123636 | 1.83E−28 | 5.03E−27 | BAZ2B | 29994 |
| ENSG00000143537 | 1.84E−28 | 5.06E−27 | ADAM15 | 8751 |
| ENSG00000072501 | 1.96E−28 | 5.37E−27 | SMC1A | 8243 |
| ENSG00000075624 | 2.01E−28 | 5.50E−27 | ACTB | 60 |
| ENSG00000115020 | 2.02E−28 | 5.52E−27 | PIKFYVE | 200576 |
| ENSG00000269893 | 2.03E−28 | 5.53E−27 | SNHG8 | 100093630 |
| ENSG00000012174 | 2.08E−28 | 5.66E−27 | MBTPS2 | 51360 |
| ENSG00000122786 | 2.12E−28 | 5.78E−27 | CALD1 | 800 |
| ENSG00000133812 | 2.20E−28 | 5.98E−27 | SBF2 | 81846 |
| ENSG00000119685 | 2.25E−28 | 6.13E−27 | TTLL5 | 23093 |
| ENSG00000254741 | 2.29E−28 | 6.23E−27 | NA | NA |
| ENSG00000115234 | 2.35E−28 | 6.37E−27 | SNX17 | 9784 |
| ENSG00000168734 | 2.36E−28 | 6.40E−27 | PKIG | 11142 |
| ENSG00000171988 | 2.55E−28 | 6.89E−27 | JMND1C | 221037 |
| ENSG00000187240 | 2.77E−28 | 7.49E−27 | DYNC2H1 | 79659 |
| ENSG00000184743 | 2.80E−28 | 7.55E−27 | ATL3 | 25923 |
| ENSG00000101126 | 2.92E−28 | 7.86E−27 | ADNP | 23394 |
| ENSG00000103152 | 3.02E−28 | 8.14E−27 | MPG | 4350 |
| ENSG00000130522 | 3.04E−28 | 8.18E−27 | JUND | 3727 |
| ENSG00000135506 | 3.14E−28 | 8.43E−27 | OS9 | 10956 |
| ENSG00000269728 | 3.22E−28 | 8.65E−27 | NA | NA |
| ENSG00000167987 | 3.28E−28 | 8.80E−27 | VPS37C | 55048 |
| ENSG00000230733 | 3.49E−28 | 9.35E−27 | NA | NA |
| ENSG00000163104 | 3.54E−28 | 9.46E−27 | SMARCAD1 | 56916 |
| ENSG00000070961 | 3.54E−28 | 9.46E−27 | ATP2B1 | 490 |
| ENSG00000185000 | 3.57E−28 | 9.52E−27 | DGAT1 | 8694 |
| ENSG00000147274 | 3.59E−28 | 9.57E−27 | RBMX | 27316 |
| ENSG00000101986 | 3.64E−28 | 9.70E−27 | ABCD1 | 215 |

TABLE 6-continued

| | | | | |
|---|---|---|---|---|
| ENSG00000075568 | 3.84E−28 | 1.02E−26 | TMEM131 | 23505 |
| ENSG00000188643 | 3.85E−28 | 1.02E−26 | S100A16 | 140576 |
| ENSG00000115053 | 4.28E−28 | 1.14E−26 | NCL | 4691 |
| ENSG00000165732 | 4.34E−28 | 1.15E−26 | DDX21 | 9188 |
| ENSG00000117472 | 4.48E−28 | 1.19E−26 | TSPAN1 | 10103 |
| ENSG00000152104 | 4.56E−28 | 1.21E−26 | PTPN14 | 5784 |
| ENSG00000054267 | 4.59E−28 | 1.21E−26 | ARID4B | 51742 |
| ENSG00000130396 | 4.63E−28 | 1.22E−26 | MLLT4 | 4301 |
| ENSG00000131437 | 4.68E−28 | 1.23E−26 | KIF3A | 11127 |
| ENSG00000089157 | 4.72E−28 | 1.24E−26 | RPLPO | 6175 |
| ENSG00000110841 | 4.90E−28 | 1.29E−26 | PPFIBP1 | 8496 |
| ENSG00000113407 | 5.05E−28 | 1.32E−26 | TARS | 6897 |
| ENSG00000131408 | 5.53E−28 | 1.45E−26 | NR1H2 | 7376 |
| ENSG00000054611 | 5.73E−28 | 1.50E−26 | TBC1D22A | 25771 |
| ENSG00000145685 | 5.90E−28 | 1.54E−26 | LHFPL2 | 10184 |
| ENSG00000113658 | 5.94E−28 | 1.55E−26 | SMAD5 | 4090 |
| ENSG00000011426 | 5.97E−28 | 1.56E−26 | ANLN | 54443 |
| ENSG00000100578 | 6.04E−28 | 1.57E−26 | KIAA0586 | 9786 |
| ENSG00000258725 | 6.27E−28 | 1.63E−26 | PRC1-AS1 | 100507118 |
| ENSG00000101846 | 6.45E−28 | 1.68E−26 | STS | 412 |
| ENSG00000131043 | 6.57E−28 | 1.71E−26 | AAR2 | 25980 |
| ENSG00000154639 | 6.69E−28 | 1.73E−26 | CXADR | 1525 |
| ENSG00000120549 | 6.74E−28 | 1.75E−26 | KIAA1217 | 56243 |
| ENSG00000162290 | 7.03E−28 | 1.82E−26 | NA | NA |
| ENSG00000108639 | 7.26E−28 | 1.88E−26 | SYNGR2 | 9144 |
| ENSG00000254004 | 7.34E−28 | 1.90E−26 | ZNF260 | 339324 |
| ENSG00000142541 | 7.47E−28 | 1.93E−26 | RPL13A | 23521 |
| ENSG00000112739 | 7.60E−28 | 1.96E−26 | PRPF4B | 8899 |
| ENSG00000116062 | 7.76E−28 | 2.00E−26 | MSH6 | 2956 |
| ENSG00000115756 | 8.10E−28 | 2.08E−26 | HPCAL1 | 3241 |
| ENSG00000153827 | 8.17E−28 | 2.10E−26 | TRIP12 | 9320 |
| ENSG00000122417 | 8.44E−28 | 2.17E−26 | ODF2L | 57489 |
| ENSG00000188883 | 8.97E−28 | 2.30E−26 | KLRG2 | 346689 |
| ENSG00000047365 | 9.16E−28 | 2.34E−26 | ARAP2 | 116984 |
| ENSG00000102189 | 9.95E−28 | 2.54E−26 | EEA1 | 8411 |
| ENSG00000082805 | 1.01E−27 | 2.58E−26 | ERC1 | 23085 |
| ENSG00000211450 | 1.01E−27 | 2.58E−26 | C11orf31 | 280636 |
| ENSG00000067221 | 1.02E−27 | 2.61E−26 | STOML1 | 9399 |
| ENSG00000174953 | 1.11E−27 | 2.82E−26 | DHX36 | 170506 |
| ENSG00000167671 | 1.12E−27 | 2.84E−26 | UBXN6 | 80700 |
| ENSG00000148290 | 1.13E−27 | 2.88E−26 | SURF1 | 6834 |
| ENSG00000160180 | 1.18E−27 | 3.00E−26 | TFF3 | 7033 |
| ENSG00000143303 | 1.20E−27 | 3.05E−26 | RRNAD1 | 51093 |
| ENSG00000007255 | 1.25E−27 | 3.16E−26 | TRAPPC6A | 79090 |
| ENSG00000135720 | 1.25E−27 | 3.17E−26 | DYNC1LI2 | 1783 |
| ENSG00000124587 | 1.27E−27 | 3.20E−26 | PEX6 | 5190 |
| ENSG00000100316 | 1.32E−27 | 3.34E−26 | RPL3 | 6122 |
| ENSG00000143669 | 1.35E−27 | 3.41E−26 | LYST | 1130 |
| ENSG00000092470 | 1.37E−27 | 3.44E−26 | WDR76 | 79968 |
| ENSG00000168014 | 1.37E−27 | 3.45E−26 | C2CD3 | 26005 |
| ENSG00000134243 | 1.41E−27 | 3.55E−26 | SORT1 | 6272 |
| ENSG00000101940 | 1.46E−27 | 3.66E−26 | WDR13 | 64743 |
| ENSG00000007541 | 1.51E−27 | 3.79E−26 | PIGQ | 9091 |
| ENSG00000135709 | 1.53E−27 | 3.83E−26 | KIAA0513 | 9764 |
| ENSG00000151612 | 1.56E−27 | 3.91E−26 | ZNF827 | 152485 |
| ENSG00000171222 | 1.57E−27 | 3.91E−26 | SCAND1 | 51282 |
| ENSG00000149823 | 1.58E−27 | 3.94E−26 | VPS51 | 738 |
| ENSG00000087086 | 1.60E−27 | 4.00E−26 | FTL | 2512 |
| ENSG00000101333 | 1.67E−27 | 4.17E−26 | PLCB4 | 5332 |
| ENSG00000169607 | 1.72E−27 | 4.27E−26 | CKAP2L | 150468 |
| ENSG00000117000 | 1.74E−27 | 4.33E−26 | RLF | 6018 |
| ENSG00000198393 | 1.83E−27 | 4.54E−26 | ZNF26 | 7574 |
| ENSG00000163681 | 1.90E−27 | 4.70E−26 | SLMAP | 7871 |
| ENSG00000168016 | 1.90E−27 | 4.71E−26 | TRANK1 | 9881 |
| ENSG00000110344 | 2.06E−27 | 5.09E−26 | UBE4A | 9354 |
| ENSG00000166025 | 2.06E−27 | 5.10E−26 | AMOTL1 | 154810 |
| ENSG00000104866 | 2.16E−27 | 5.34E−26 | PPP1R37 | 284352 |
| ENSG00000174292 | 2.18E−27 | 5.38E−26 | TNK1 | 8711 |
| ENSG00000120063 | 2.28E−27 | 5.61E−26 | GNA13 | 10672 |
| ENSG00000175866 | 2.31E−27 | 5.68E−26 | BAIAP2 | 10458 |
| ENSG00000167767 | 2.37E−27 | 5.83E−26 | KRT80 | 144501 |
| ENSG00000011405 | 2.42E−27 | 5.94E−26 | PIK3C2A | 5286 |
| ENSG00000064393 | 2.52E−27 | 6.17E−26 | HIPK2 | 28996 |
| ENSG00000001631 | 2.56E−27 | 6.28E−26 | KRIT1 | 889 |
| ENSG00000198858 | 2.59E−27 | 6.34E−26 | R3HDM4 | 91300 |
| ENSG00000115468 | 2.80E−27 | 6.85E−26 | EFHD1 | 80303 |
| ENSG00000198399 | 2.89E−27 | 7.06E−26 | ITSN2 | 50618 |
| ENSG00000101347 | 2.94E−27 | 7.16E−26 | SAMHD1 | 25939 |
| ENSG00000176108 | 3.00E−27 | 7.31E−26 | CHMP6 | 79643 |
| ENSG00000105671 | 3.03E−27 | 7.38E−26 | DDX49 | 54555 |

TABLE 6-continued

| | | | | |
|---|---|---|---|---|
| ENSG00000069011 | 3.19E−27 | 7.77E−26 | PITX1 | 5307 |
| ENSG00000160445 | 3.20E−27 | 7.77E−26 | ZER1 | 10444 |
| ENSG00000138629 | 3.26E−27 | 7.91E−26 | UBL7 | 84993 |
| ENSG00000167642 | 3.33E−27 | 8.07E−26 | SPINT2 | 10653 |
| ENSG00000108219 | 3.42E−27 | 8.27E−26 | TSPAN14 | 81619 |
| ENSG00000141741 | 3.49E−27 | 8.44E−26 | MIEN1 | 84299 |
| ENSG00000088280 | 3.52E−27 | 8.50E−26 | ASAP3 | 55616 |
| ENSG00000168172 | 3.63E−27 | 8.76E−26 | HOOK3 | 84376 |
| ENSG00000138642 | 3.69E−27 | 8.91E−26 | HERC6 | 55008 |
| ENSG00000227500 | 3.76E−27 | 9.05E−26 | SCAMP4 | 113178 |
| ENSG00000224383 | 3.87E−27 | 9.31E−26 | PRR29 | 92340 |
| ENSG00000086544 | 3.88E−27 | 9.33E−26 | ITPKC | 80271 |
| ENSG00000082497 | 4.00E−27 | 9.59E−26 | SERTAD4 | 56256 |
| ENSG00000122566 | 4.00E−27 | 9.59E−26 | HNRNPA2B1 | 3181 |
| ENSG00000168769 | 4.10E−27 | 9.82E−26 | TET2 | 54790 |
| ENSG00000129103 | 4.28E−27 | 1.02E−25 | SUMF2 | 25870 |
| ENSG00000139318 | 4.45E−27 | 1.06E−25 | DUSP6 | 1848 |
| ENSG00000196305 | 4.48E−27 | 1.07E−25 | IARS | 3376 |
| ENSG00000003756 | 4.50E−27 | 1.07E−25 | RBM5 | 10181 |
| ENSG00000090612 | 4.55E−27 | 1.08E−25 | ZNF268 | 10795 |
| ENSG00000140694 | 4.86E−27 | 1.16E−25 | PARN | 5073 |
| ENSG00000134852 | 4.92E−27 | 1.17E−25 | CLOCK | 9575 |
| ENSG00000151503 | 5.45E−27 | 1.29E−25 | NCAPD3 | 23310 |
| ENSG00000070214 | 5.53E−27 | 1.31E−25 | SLC44A1 | 23446 |
| ENSG00000101350 | 5.53E−27 | 1.31E−25 | KIF3B | 9371 |
| ENSG00000171444 | 6.08E−27 | 1.44E−25 | MCC | 4163 |
| ENSG00000104081 | 6.15E−27 | 1.46E−25 | BMF | 90427 |
| ENSG00000163946 | 6.16E−27 | 1.46E−25 | FAM208A | 23272 |
| ENSG00000158828 | 6.17E−27 | 1.46E−25 | PINK1 | 65018 |
| ENSG00000141219 | 6.19E−27 | 1.46E−25 | C17orf80 | 55028 |
| ENSG00000143801 | 6.23E−27 | 1.47E−25 | PSEN2 | 5664 |
| ENSG00000106080 | 6.34E−27 | 1.49E−25 | FKBP14 | 55033 |
| ENSG00000131165 | 6.37E−27 | 1.50E−25 | CHMP1A | 5119 |
| ENSG00000091009 | 6.42E−27 | 1.51E−25 | RBM27 | 54439 |
| ENSG00000104142 | 6.51E−27 | 1.53E−25 | VPS18 | 57617 |
| ENSG00000070404 | 6.69E−27 | 1.57E−25 | FSTL3 | 10272 |
| ENSG00000160948 | 6.93E−27 | 1.62E−25 | VPS28 | 51160 |
| ENSG00000121680 | 6.96E−27 | 1.63E−25 | PEX16 | 9409 |
| ENSG00000056097 | 7.38E−27 | 1.72E−25 | ZFR | 51663 |
| ENSG00000184292 | 7.63E−27 | 1.78E−25 | TACSTD2 | 4070 |
| ENSG00000015676 | 7.67E−27 | 1.79E−25 | NUDCD3 | 23386 |
| ENSG00000126062 | 7.79E−27 | 1.82E−25 | TMEM115 | 11070 |
| ENSG00000129315 | 7.95E−27 | 1.85E−25 | CCNT1 | 904 |
| ENSG00000105357 | 7.98E−27 | 1.85E−25 | MYH14 | 79784 |
| ENSG00000164081 | 8.35E−27 | 1.94E−25 | TEX264 | 51368 |
| ENSG00000158417 | 8.67E−27 | 2.01E−25 | EIF5B | 9669 |
| ENSG00000167965 | 8.77E−27 | 2.03E−25 | MLST8 | 64223 |
| ENSG00000115183 | 8.80E−27 | 2.04E−25 | TANC1 | 85461 |
| ENSG00000173674 | 8.81E−27 | 2.04E−25 | EIF1AX | 1964 |
| ENSG00000103064 | 8.83E−27 | 2.04E−25 | SLC7A6 | 9057 |
| ENSG00000158710 | 9.15E−27 | 2.11E−25 | TAGLN2 | 8407 |
| ENSG00000064601 | 9.49E−27 | 2.19E−25 | CTSA | 5476 |
| ENSG00000131242 | 9.53E−27 | 2.20E−25 | RAB11FIP4 | 84440 |
| ENSG00000179218 | 9.58E−27 | 2.20E−25 | CALR | 811 |
| ENSG00000100284 | 9.61E−27 | 2.21E−25 | TOM1 | 10043 |
| ENSG00000100227 | 9.89E−27 | 2.27E−25 | POLDIP3 | 84271 |
| ENSG00000056586 | 9.93E−27 | 2.28E−25 | RC3H2 | 54542 |
| ENSG00000135069 | 1.01E−26 | 2.31E−25 | PSAT1 | 29968 |
| ENSG00000167565 | 1.02E−26 | 2.33E−25 | SERTAD3 | 29946 |
| ENSG00000151893 | 1.02E−26 | 2.34E−25 | CACUL1 | 143384 |
| ENSG00000136628 | 1.02E−26 | 2.34E−25 | EPRS | 2058 |
| ENSG00000255455 | 1.09E−26 | 2.48E−25 | LOC103611081 | 103611081 |

| NAME | SIZE | ES | NES | NOM p-val | FDR q-val | FWER p-val | RANK AT MAX | LEADING EDGE |
|---|---|---|---|---|---|---|---|---|
| GABRIELY_MIR21_TARGETS | 275 | 0.7787431 | 3.2013996 | 0 | 0 | 0 | 3255 | tags = 77%, list = 16%, signal = 90% |
| ZHANG_TLX_TARGETS_36HR_DN | 178 | 0.8050206 | 3.1536746 | 0 | 0 | 0 | 3018 | tags = 82%, list = 15%, signal = 95% |
| DACOSTA_UV_RESPONSE_VIA_ERCC3_COMMON_DN | 466 | 0.7304403 | 3.140505 | 0 | 0 | 0 | 2957 | tags = 62%, list = 14%, signal = 71% |
| SENGUPTA_NASOPHARYNGEAL_CARCINOMA_UP | 273 | 0.71399444 | 2.9295986 | 0 | 0 | 0 | 3846 | tags = 62%, list = 19%, signal = 75% |
| DAZARD_RESPONSE_TO_UV_NHEK_DN | 299 | 0.70445377 | 2.9117284 | 0 | 0 | 0 | 3265 | tags = 61%, list = 16%, signal = 72% |
| ZHANG_TLX_TARGETS_UP | 87 | 0.8025339 | 2.8555348 | 0 | 0 | 0 | 3018 | tags = 80%, list = 15%, signal = 94% |
| PYEON_CANCER_HEAD_AND_NECK_VS_CERVICAL_UP | 174 | 0.72628593 | 2.85267 | 0 | 0 | 0 | 3274 | tags = 72%, list = 16%, signal = 85% |
| SENGUPTA_NASOPHARYNGEAL_CARCINOMA_WITH_LMP1_UP | 367 | 0.65694815 | 2.7785761 | 0 | 0 | 0 | 4254 | tags = 59%, list = 21%, signal = 73% |
| DAZARD_UV_RESPONSE_CLUSTER_G6 | 142 | 0.72171134 | 2.7662475 | 0 | 0 | 0 | 3049 | tags = 62%, list = 15%, signal = 72% |
| SHEN_SMARCA2_TARGETS_UP | 407 | 0.64456695 | 2.7363276 | 0 | 0 | 0 | 3922 | tags = 57%, list = 19%, signal = 70% |
| BIDUS_METASTASIS_UP | 206 | 0.6794813 | 2.7189422 | 0 | 0 | 0 | 3002 | tags = 57%, list = 15%, signal = 66% |
| MITSIADES_RESPONSE_TO_APLIDIN_DN | 235 | 0.65885025 | 2.6798284 | 0 | 0 | 0 | 2657 | tags = 53%, list = 13%, signal = 60% |
| KONG_E2F3_TARGETS | 90 | 0.74710494 | 2.6763902 | 0 | 0 | 0 | 3147 | tags = 64%, list = 15%, signal = 76% |
| MILI_PSEUDOPODIA_HAPTOTAXIS_UP | 488 | 0.6240065 | 2.6654716 | 0 | 0 | 0 | 4317 | tags = 56%, list = 21%, signal = 69% |
| ROSTY_CERVICAL_CANCER_PROLIFERATION_CLUSTER | 135 | 0.69733113 | 2.6449435 | 0 | 0 | 0 | 2999 | tags = 59%, list = 15%, signal = 69% |
| IKEDA_MIR30_TARGETS_UP | 112 | 0.7171822 | 2.6358354 | 0 | 0 | 0 | 3361 | tags = 62%, list = 16%, signal = 73% |
| PUJANA_XPRSS_INT_NETWORK | 162 | 0.6846715 | 2.6312819 | 0 | 0 | 0 | 2650 | tags = 54%, list = 13%, signal = 62% |
| ZHANG_BREAST_CANCER_PROGENITORS_UP | 395 | 0.6208936 | 2.6112168 | 0 | 0 | 0 | 3393 | tags = 50%, list = 17%, signal = 59% |
| PYEON_HPV_POSITIVE_TUMORS_UP | 87 | 0.7315743 | 2.6091037 | 0 | 0 | 0 | 2869 | tags = 59%, list = 14%, signal = 68% |
| ZHAN_MULTIPLE_MYELOMA_PR_UP | 44 | 0.8121153 | 2.601259 | 0 | 0 | 0 | 2711 | tags = 77%, list = 13%, signal = 89% |
| KOBAYASHI_EGFR_SIGNALING_24HR_DN | 241 | 0.64446574 | 2.601089 | 0 | 0 | 0 | 3626 | tags = 53%, list = 18%, signal = 64% |
| WINNEPENNINCKX_MELANOMA_METASTASIS_UP | 152 | 0.6668578 | 2.5785322 | 0 | 0 | 0 | 2657 | tags = 53%, list = 13%, signal = 61% |
| LEE_EARLY_T_LYMPHOCYTE_UP | 96 | 0.71621877 | 2.5773723 | 0 | 0 | 0 | 2873 | tags = 58%, list = 14%, signal = 68% |
| ZHANG_TLX_TARGETS_60HR_DN | 264 | 0.6304554 | 2.5712037 | 0 | 0 | 0 | 3018 | tags = 52%, list = 15%, signal = 60% |
| ODONNELL_TFRC_TARGETS_DN | 121 | 0.68039626 | 2.5438 | 0 | 0 | 0 | 2856 | tags = 53%, list = 14%, signal = 61% |
| WU_APOPTOSIS_BY_CDKN1A_VIA_TP53 | 54 | 0.7672621 | 2.5230453 | 0 | 0 | 0 | 2609 | tags = 70%, list = 13%, signal = 80% |
| JOHNSTONE_PARVB_TARGETS_2_DN | 315 | 0.6024317 | 2.5115752 | 0 | 0 | 0 | 3608 | tags = 52%, list = 18%, signal = 62% |
| PUJANA_BRCA_CENTERED_NETWORK | 114 | 0.6750067 | 2.485505 | 0 | 0 | 0 | 3816 | tags = 64%, list = 19%, signal = 78% |
| DE_YY1_TARGETS_DN | 89 | 0.6896358 | 2.4748182 | 0 | 0 | 0 | 2149 | tags = 56%, list = 10%, signal = 62% |
| CHEN_HOXA5_TARGETS_9HR_UP | 205 | 0.6208788 | 2.46617 | 0 | 0 | 0 | 3571 | tags = 55%, list = 17%, signal = 66% |
| DACOSTA_UV_RESPONSE_VIA_ERCC3_XPCS_DN | 83 | 0.69028836 | 2.4630673 | 0 | 0 | 0 | 3187 | tags = 59%, list = 16%, signal = 70% |
| CHANG_CYCLING_GENES | 139 | 0.64297974 | 2.461934 | 0 | 0 | 0 | 3018 | tags = 53%, list = 15%, signal = 62% |
| ZHENG_FOXP3_TARGETS_IN_THYMUS_UP | 180 | 0.6217587 | 2.4460707 | 0 | 0 | 0 | 3869 | tags = 56%, list = 19%, signal = 69% |
| FERREIRA_EWINGS_SARCOMA_UNSTABLE_VS_STABLE_UP | 149 | 0.64031523 | 2.443248 | 0 | 0 | 0 | 2909 | tags = 50%, list = 14%, signal = 57% |
| PUJANA_BRCA2_PCC_NETWORK | 400 | 0.5790918 | 2.4373984 | 0 | 0 | 0 | 3566 | tags = 50%, list = 17%, signal = 59% |
| DUTERTRE_ESTRADIOL_RESPONSE_24HR_UP | 312 | 0.5843985 | 2.4370499 | 0 | 0 | 0 | 3089 | tags = 47%, list = 15%, signal = 55% |
| FARMER_BREAST_CANCER_CLUSTER_2 | 32 | 0.8210367 | 2.4310553 | 0 | 0 | 0 | 1765 | tags = 69%, list = 9%, signal = 75% |
| FUJII_YBX1_TARGETS_DN | 191 | 0.61856985 | 2.42701 | 0 | 0 | 0 | 3131 | tags = 49%, list = 15%, signal = 57% |
| BILD_CTNNB1_ONCOGENIC_SIGNATURE | 77 | 0.68320215 | 2.4107528 | 0 | 0 | 0 | 2588 | tags = 60%, list = 13%, signal = 68% |
| ISHIDA_E2F_TARGETS | 50 | 0.73273975 | 2.4016232 | 0 | 0 | 0 | 2305 | tags = 56%, list = 11%, signal = 63% |
| CHIANG_LIVER_CANCER_SUBCLASS_PROLIFERATION_UP | 165 | 0.6115413 | 2.399496 | 0 | 0 | 0 | 2634 | tags = 45%, list = 13%, signal = 52% |
| SENESE_HDAC1_TARGETS | 417 | 0.5618158 | 2.3914373 | 0 | 0 | 0 | 4213 | tags = 56%, list = 21%, signal = 69% |
| VANTVEER_BREAST_CANCER_METASTASIS_DN | 111 | 0.6442309 | 2.38474 | 0 | 0 | 0 | 2942 | tags = 50%, list = 14%, signal = 58% |
| DACOSTA_UV_RESPONSE_VIA_ERCC3_TTD_DN | 81 | 0.67910653 | 2.376875 | 0 | 0 | 0 | 3187 | tags = 62%, list = 16%, signal = 73% |
| KANG_DOXORUBICIN_RESISTANCE_UP | 52 | 0.7462963 | 2.3768451 | 0 | 0 | 0 | 2873 | tags = 65%, list = 14%, signal = 76% |
| MOLENAAR_TARGETS_OF_CCND1_AND_CDK4_DN | 52 | 0.7233696 | 2.3766482 | 0 | 0 | 0 | 2338 | tags = 65%, list = 11%, signal = 74% |
| KAMMINGA_EZH2_TARGETS | 40 | 0.75476277 | 2.3730714 | 0 | 0 | 0 | 3118 | tags = 65%, list = 15%, signal = 77% |
| WHITFIELD_CELL_CYCLE_S | 148 | 0.6141077 | 2.372529 | 0 | 0 | 0 | 4039 | tags = 61%, list = 20%, signal = 75% |
| VERNELL_RETINOBLASTOMA_PATHWAY_UP | 68 | 0.689651 | 2.366721 | 0 | 0 | 0 | 3652 | tags = 63%, list = 18%, signal = 77% |
| CHICAS_RB1_TARGETS_GROWING | 227 | 0.58323693 | 2.3638465 | 0 | 0 | 0 | 3798 | tags = 44%, list = 19%, signal = 53% |

-continued

| NAME | SIZE | ES | NES | NOM p-val | FDR q-val | FWER p-val | RANK AT MAX | LEADING EDGE |
|---|---|---|---|---|---|---|---|---|
| BURTON_ADIPOGENESIS_3 | 98 | 0.65541905 | 2.3620465 | 0 | 0 | 0 | 3018 | tags = 50%, list = 15%, signal = 58% |
| ZHENG_BOUND_BY_FOXP3 | 444 | 0.5528688 | 2.3611922 | 0 | 0 | 0 | 4025 | tags = 47%, list = 20%, signal = 57% |
| ZHOU_CELL_CYCLE_GENES_IN_IR_RESPONSE_24HR | 121 | 0.6318684 | 2.3535223 | 0 | 0 | 0 | 3027 | tags = 48%, list = 15%, signal = 56% |
| WHITFIELD_CELL_CYCLE_LITERATURE | 44 | 0.7400965 | 2.3502703 | 0 | 2.08E-05 | 0.001 | 1776 | tags = 50%, list = 9%, signal = 55% |
| REICHERT_MITOSIS_LIN9_TARGETS | 28 | 0.8227934 | 2.3413856 | 0 | 2.04E-05 | 0.001 | 2414 | tags = 79%, list = 12%, signal = 89% |
| PECE_MAMMARY_STEM_CELL_DN | 123 | 0.62821645 | 2.3339314 | 0 | 2.00E-05 | 0.001 | 4320 | tags = 59%, list = 21%, signal = 74% |
| LU_EZH2_TARGETS_ON | 347 | 0.5547575 | 2.3323421 | 0 | 1.97E-05 | 0.001 | 4298 | tags = 52%, list = 21%, signal = 65% |
| SHEDDEN_LUNG_CANCER_POOR_SURVIVAL_A6 | 423 | 0.5438258 | 2.32875 | 0 | 1.93E-05 | 0.001 | 3018 | tags = 43%, list = 15%, signal = 49% |
| SENESE_HDAC3_TARGETS_UP | 457 | 0.5408473 | 2.3266313 | 0 | 1.90E-05 | 0.001 | 3823 | tags = 50%, list = 19%, signal = 60% |
| TANG_SENESCENCE_TP53_TARGETS_DN | 54 | 0.7083598 | 2.3165104 | 0 | 1.87E-05 | 0.001 | 2579 | tags = 54%, list = 13%, signal = 61% |
| KIM_GERMINAL_CENTER_T_HELPER_UP | 58 | 0.68941456 | 2.3162951 | 0 | 1.84E-05 | 0.001 | 4385 | tags = 57%, list = 21%, signal = 72% |
| BURTON_ADIPOGENESIS_12 | 31 | 0.7948331 | 2.3147068 | 0 | 1.81E-05 | 0.001 | 2666 | tags = 68%, list = 13%, signal = 78% |
| GEORGES_CELL_CYCLE_MIR192_TARGETS | 60 | 0.6880409 | 2.3135161 | 0 | 1.78E-05 | 0.001 | 4250 | tags = 70%, list = 21%, signal = 88% |
| SOTIRIOU_BREAST_CANCER_GRADE_1_VS_3_UP | 145 | 0.60148937 | 2.306879 | 0 | 1.75E-05 | 0.001 | 2737 | tags = 46%, list = 13%, signal = 53% |
| KAUFFMANN_MELANOMA_RELAPSE_UP | 58 | 0.6844562 | 2.302862 | 0 | 1.73E-05 | 0.001 | 2999 | tags = 57%, list = 15%, signal = 66% |
| CROONQUIST_IL6_DEPRIVATION_DN | 98 | 0.64148927 | 2.2970886 | 0 | 1.70E-05 | 0.001 | 3011 | tags = 52%, list = 15%, signal = 61% |
| THUM_SYSTOLIC_HEART_FAILURE_DN | 213 | 0.57113445 | 2.2943308 | 0 | 1.67E-05 | 0.001 | 2892 | tags = 45%, list = 14%, signal = 52% |
| PUJANA_BREAST_CANCER_WITH_BRCA1_MUTATED_UP | 55 | 0.68575559 | 2.291393 | 0 | 1.65E-05 | 0.001 | 3638 | tags = 64%, list = 18%, signal = 77% |
| HOFFMANN_LARGE_TO_SMALL_PRE_BII_LYMPHOCYTE_UP | 157 | 0.5875846 | 2.2876801 | 0 | 1.63E-05 | 0.001 | 2376 | tags = 46%, list = 12%, signal = 52% |
| DEBIASI_APOPTOSIS_BY_REOVIRUS_INFECTION_UP | 296 | 0.5560954 | 2.2850885 | 0 | 1.60E-05 | 0.001 | 3507 | tags = 46%, list = 17%, signal = 55% |
| OSMAN_BLADDER_CANCER_UP | 382 | 0.53867584 | 2.284999 | 0 | 1.58E-05 | 0.001 | 3966 | tags = 52%, list = 19%, signal = 63% |
| ENK_UV_RESPONSE_KERATINOCYTE_DN | 475 | 0.5267979 | 2.2781215 | 0 | 1.56E-05 | 0.001 | 3265 | tags = 43%, list = 16%, signal = 49% |
| EGUCHI_CELL_CYCLE_RB1_TARGETS | 23 | 0.82074505 | 2.2751951 | 0 | 1.54E-05 | 0.001 | 2252 | tags = 70%, list = 11%, signal = 78% |
| WENDT_COHESIN_TARGETS_UP | 32 | 0.7561624 | 2.2709608 | 0 | 1.52E-05 | 0.001 | 2897 | tags = 63%, list = 14%, signal = 73% |
| MARTINEZ_RESPONSE_TO_TRABECTEDIN_DN | 263 | 0.5530803 | 2.2685385 | 0 | 1.50E-05 | 0.001 | 4417 | tags = 59%, list = 22%, signal = 74% |
| BENPORATH_PROLIFERATION | 135 | 0.5967387 | 2.2626433 | 0 | 1.48E-05 | 0.001 | 3030 | tags = 44%, list = 15%, signal = 52% |
| HUTTMANN_B_CLL_POOR_SURVIVAL_DN | 50 | 0.69942766 | 2.2540805 | 0 | 1.46E-05 | 0.001 | 2829 | tags = 52%, list = 14%, signal = 60% |
| GINESTIER_BREAST_CANCER_ZNF217_AMPLIFIED_UP | 69 | 0.647876 | 2.2499635 | 0 | 1.44E-05 | 0.001 | 2320 | tags = 51%, list = 11%, signal = 57% |
| WAMUNYOKOLI_OVARIAN_CANCER_LMP_DN | 183 | 0.5722051 | 2.2481227 | 0 | 1.42E-05 | 0.001 | 4903 | tags = 52%, list = 24%, signal = 68% |
| LI_WILMS_TUMOR_VS_FETAL_KIDNEY_1_DN | 158 | 0.5762397 | 2.2447796 | 0 | 1.40E-05 | 0.001 | 2304 | tags = 37%, list = 11%, signal = 42% |
| CROONQUIST_NRAS_SIGNALING_DN | 72 | 0.6475057 | 2.2289863 | 0 | 1.38E-05 | 0.001 | 2776 | tags = 54%, list = 14%, signal = 62% |
| MARTORIATI_MDM4_TARGETS_FETAL_LIVER_DN | 490 | 0.51104003 | 2.2016559 | 0 | 1.25E-05 | 0.001 | 3200 | tags = 43%, list = 16%, signal = 49% |
| ODONNELL_TARGETS_OF_MYC_AND_TFRC_DN | 42 | 0.7066623 | 2.2242386 | 0 | 1.37E-05 | 0.001 | 2639 | tags = 57%, list = 13%, signal = 65% |
| WILCOX_RESPONSE_TO_PROGESTERONE_UP | 138 | 0.5779511 | 2.223136 | 0 | 1.35E-05 | 0.001 | 3372 | tags = 43%, list = 16%, signal = 51% |
| RIGGINS_TAMOXIFEN_RESISTANCE_DN | 211 | 0.554833 | 2.222347 | 0 | 1.34E-05 | 0.001 | 4881 | tags = 58%, list = 24%, signal = 75% |
| IWANAGA_E2F1_TARGETS_INDUCED_BY_SERUM | 29 | 0.75739866 | 2.218054 | 0 | 1.32E-05 | 0.001 | 3850 | tags = 76%, list = 19%, signal = 93% |
| XU_HGF_TARGETS_INDUCED_BY_AKT1_48HR_DN | 23 | 0.7997435 | 2.2174833 | 0 | 1.30E-05 | 0.001 | 2924 | tags = 74%, list = 14%, signal = 86% |
| WHITFORD_PEDIATRIC_CANCER_MARKERS | 108 | 0.594413 | 2.216729 | 0 | 1.29E-05 | 0.001 | 3011 | tags = 48%, list = 15%, signal = 56% |
| ZHOU_CELL_CYCLE_GENES_IN_IR_RESPONSE_6HR | 81 | 0.62955487 | 2.2136307 | 0 | 1.27E-05 | 0.001 | 2414 | tags = 46%, list = 12%, signal = 52% |
| DEURIG_T_CELL_PROLYMPHOCYTIC_LEUKEMIA_DN | 282 | 0.53555053 | 2.2125146 | 0 | 1.26E-05 | 0.001 | 4148 | tags = 44%, list = 20%, signal = 55% |
| GENTILE_UV_RESPONSE_CLUSTER_D4 | 54 | 0.6648425 | 2.1953778 | 0 | 1.23E-05 | 0.001 | 3864 | tags = 63%, list = 19%, signal = 77% |
| MISSIAGLIA_REGULATED_BY_METHYLATION_DN | 117 | 0.585582 | 2.19301 | 0 | 1.22E-05 | 0.001 | 2418 | tags = 45%, list = 12%, signal = 51% |
| MARKEY_RB1_ACUTE_LOF_DN | 220 | 0.5458184 | 2.192444 | 0 | 1.21E-05 | 0.001 | 2338 | tags = 37%, list = 11%, signal = 41% |
| MOSERLE_IFNA_RESPONSE | 31 | 0.7348585 | 2.1898506 | 0 | 1.19E-05 | 0.001 | 4044 | tags = 68%, list = 20%, signal = 84% |
| TURASHVILI_BREAST_DUCTAL_CARCINOMA_VS_LOBULAR_NORMAL | 72 | 0.63404036 | 2.1889477 | 0 | 1.18E-05 | 0.001 | 3615 | tags = 51%, list = 18%, signal = 62% |
| REACTOME_GENERIC_TRANSCRIPTION_PATHWAY | 326 | 0.5226834 | 2.1886504 | 0 | 1.17E-05 | 0.001 | 4394 | tags = 58%, list = 21%, signal = 72% |
| SU_TESTIS | 63 | 0.63899399 | 2.1882734 | 0 | 1.16E-05 | 0.001 | 3110 | tags = 54%, list = 15%, signal = 63% |
| TOYOTA_TARGETS_OF_MIR34B_AND_MIR34C | 409 | 0.51246846 | 2.1787 | 0 | 1.14E-05 | 0.001 | 3851 | tags = 51%, list = 19%, signal = 62% |
| GREENBAUM_E2A_TARGETS_UP | 33 | 0.71752435 | 2.1752214 | 0 | 2.28E-05 | 0.002 | 2305 | tags = 58%, list = 11%, signal = 65% |
| HORIUCHI_WTAP_TARGETS_DN | 293 | 0.52618396 | 2.1713672 | 0 | 2.26E-05 | 0.002 | 3192 | tags = 44%, list = 16%, signal = 52% |
| YU_MYC_TARGETS_UP | 40 | 0.6933403 | 2.171352 | 0 | 2.24E-05 | 0.002 | 2305 | tags = 52%, list = 11%, signal = 59% |

| NAME | SIZE | ES | NES | NOM p-val | FDR q-val | FWER p-val | RANK AT MAX | LEADING EDGE |
| --- | --- | --- | --- | --- | --- | --- | --- | --- |
| BURTON_ADIPOGENESIS_11 | 52 | 0.6673064 | 2.170409 | 0 | 2.21E-05 | 0.002 | 3703 | tags = 62%, list = 18%, signal = 75% |
| CHIARETTI_T_ALL_RELAPSE_PROGNOSIS | 19 | 0.811566 | 2.1533203 | 0 | 2.19E-05 | 0.002 | 2689 | tags = 68%, list = 13%, signal = 79% |
| GRAHAM_NORMAL_QUIESCENT_VS_NORMAL_DIVIDING_DN | 84 | 0.5945527 | 2.1491854 | 0 | 2.17E-05 | 0.002 | 2634 | tags = 46%, list = 13%, signal = 53% |
| CHIBA_RESPONSE_TO_TSA_DN | 22 | 0.79682076 | 2.1432898 | 0 | 2.15E-05 | 0.002 | 2829 | tags = 73%, list = 14%, signal = 84% |
| JAEGER_METASTATIS_UP | 43 | 0.6798403 | 2.1350858 | 0 | 4.20E-05 | 0.004 | 2930 | tags = 42%, list = 14%, signal = 49% |
| CARD_MIR302A_TARGETS | 73 | 0.6079185 | 2.1250277 | 0 | 5.20E-05 | 0.005 | 2662 | tags = 45%, list = 13%, signal = 52% |
| FURUKAWA_DUSP6_TARGETS_PCI35_DN | 67 | 0.61720276 | 2.1196275 | 0 | 6.20E-05 | 0.006 | 3751 | tags = 54%, list = 18%, signal = 66% |
| REACTOME_MITOTIC_PROMETAPHASE | 81 | 0.5991925 | 2.1193142 | 0 | 6.15E-05 | 0.006 | 3143 | tags = 56%, list = 15%, signal = 65% |
| DING_LUNG_CANCER_EXPRESSION_BY_COPY_NUMBER | 99 | 0.57666236 | 2.1174946 | 0 | 6.09E-05 | 0.006 | 3969 | tags = 58%, list = 19%, signal = 71% |
| YANAGIHARA_ESX1_TARGETS | 27 | 0.73912066 | 2.116019 | 0 | 6.04E-05 | 0.006 | 2272 | tags = 56%, list = 11%, signal = 62% |
| MORI_LARGE_PRE_BII_LYMPHOCYTE_UP | 83 | 0.58888996 | 2.1149004 | 0 | 5.98E-05 | 0.006 | 2526 | tags = 42%, list = 12%, signal = 48% |
| IKEDA_MIR1_TARGETS_UP | 53 | 0.63872606 | 2.1146457 | 0 | 5.93E-05 | 0.006 | 4213 | tags = 60%, list = 21%, signal = 76% |
| ABRAMSON_INTERACT_WITH_AIRE | 43 | 0.65063673 | 2.1103292 | 0 | 7.81E-05 | 0.008 | 2149 | tags = 53%, list = 10%, signal = 60% |
| FINETTI_BREAST_CANCER_KINOME_RED | 16 | 0.83302295 | 2.1099133 | 0 | 7.75E-05 | 0.008 | 2873 | tags = 81%, list = 14%, signal = 94% |
| HOEBEKE_LYMPHOID_STEM_CELL_UP | 84 | 0.5974085 | 2.1008897 | 0 | 1.06E-04 | 0.011 | 2753 | tags = 36%, list = 13%, signal = 41% |
| SESTO_RESPONSE_TO_UV_C5 | 46 | 0.6550558 | 2.1001627 | 0 | 1.05E-04 | 0.011 | 3919 | tags = 70%, list = 19%, signal = 86% |
| CHANDRAN_METASTASIS_UP | 194 | 0.5232353 | 2.0891197 | 0 | 1.23E-04 | 0.013 | 2342 | tags = 39%, list = 11%, signal = 44% |
| STEIN_ESRRA_TARGETS_RESPONSIVE_TO_ESTROGEN_DN | 38 | 0.68464005 | 2.087819 | 0 | 1.50E-04 | 0.016 | 3974 | tags = 68%, list = 19%, signal = 85% |
| RODRIGUES_THYROID_CARCINOMA_DN | 73 | 0.6076258 | 2.0856495 | 0 | 1.48E-04 | 0.016 | 3053 | tags = 52%, list = 15%, signal = 61% |
| BROWNE_HCMV_INFECTION_6HR_DN | 150 | 0.5462222 | 2.0849524 | 0 | 1.47E-04 | 0.016 | 3815 | tags = 43%, list = 19%, signal = 53% |
| MORI_IMMATURE_B_LYMPHOCYTE_DN | 88 | 0.5918592 | 2.0826354 | 0 | 1.46E-04 | 0.016 | 3039 | tags = 49%, list = 15%, signal = 57% |
| GENTILE_UV_HIGH_DOSE_DN | 295 | 0.506376 | 2.081521 | 0 | 1.45E-04 | 0.016 | 3493 | tags = 42%, list = 17%, signal = 50% |
| GAVIN_FOXP3_TARGETS_CLUSTER_P6 | 86 | 0.5910501 | 2.080328 | 0 | 1.43E-04 | 0.016 | 2384 | tags = 38%, list = 12%, signal = 43% |
| WHITFIELD_CELL_CYCLE_G2_M | 202 | 0.5192177 | 2.0798695 | 0 | 1.42E-04 | 0.016 | 2416 | tags = 36%, list = 12%, signal = 40% |
| SHEPARD_CRUSH_AND_BURN_MUTANT_DN | 164 | 0.5383136 | 2.0792286 | 0 | 1.41E-04 | 0.016 | 3490 | tags = 41%, list = 17%, signal = 49% |
| SENESE_HDAC2_TARGETS_UP | 105 | 0.567019 | 2.0769079 | 0 | 1.49E-04 | 0.017 | 4131 | tags = 56%, list = 20%, signal = 70% |
| PID_FANCONI_PATHWAY | 44 | 0.6487903 | 2.0767417 | 0 | 1.48E-04 | 0.017 | 3638 | tags = 66%, list = 18%, signal = 80% |
| REACTOME_G2_M_CHECKPOINTS | 41 | 0.6544702 | 2.0688298 | 0 | 1.47E-04 | 0.017 | 2619 | tags = 56%, list = 13%, signal = 64% |
| GRAHAM_CML_DIVIDING_VS_NORMAL_QUIESCENT_UP | 168 | 0.52728486 | 2.0673056 | 0 | 1.63E-04 | 0.019 | 3011 | tags = 40%, list = 15%, signal = 47% |
| ONDER_CDH1_TARGETS_1_DN | 159 | 0.53199327 | 2.064098 | 0 | 1.79E-04 | 0.021 | 4119 | tags = 44%, list = 20%, signal = 55% |
| CHEMNITZ_RESPONSE_TO_PROSTAGLANDIN_E2_UP | 133 | 0.5407899 | 2.0621347 | 0 | 1.86E-04 | 0.022 | 2774 | tags = 41%, list = 14%, signal = 48% |
| REN_BOUND_BY_E2F | 61 | 0.61362475 | 2.0611908 | 0 | 1.93E-04 | 0.023 | 2273 | tags = 46%, list = 11%, signal = 51% |
| SAKAI_CHRONIC_HEPATITIS_VS_LIVER_CANCER_UP | 78 | 0.57943684 | 2.058524 | 0 | 2.08E-04 | 0.025 | 4094 | tags = 54%, list = 20%, signal = 67% |
| SHEPARD_BMYB_TARGETS | 67 | 0.60727876 | 2.056022 | 0 | 2.06E-04 | 0.025 | 2414 | tags = 42%, list = 12%, signal = 47% |
| SEIDEN_ONCOGENESIS_BY_MET | 85 | 0.5810204 | 2.054272 | 0 | 2.13E-04 | 0.026 | 3968 | tags = 56%, list = 19%, signal = 70% |
| GENTILE_UV_LOW_DOSE_DN | 64 | 0.60011417 | 2.0431051 | 0 | 2.86E-04 | 0.035 | 3847 | tags = 52%, list = 19%, signal = 63% |
| GALE_APL_WITH_FLT3_MUTATED_UP | 54 | 0.6151422 | 2.0422065 | 0 | 2.84E-04 | 0.035 | 3143 | tags = 52%, list = 15%, signal = 61% |
| KIM_MYC_AMPLIFICATION_TARGETS_DN | 88 | 0.57728714 | 2.0376153 | 0 | 3.22E-04 | 0.039 | 4583 | tags = 63%, list = 22%, signal = 80% |
| JOHNSTONE_PARVB_TARGETS_1_DN | 55 | 0.6156109 | 2.0354347 | 0 | 3.20E-04 | 0.039 | 4026 | tags = 58%, list = 20%, signal = 72% |
| BROWNE_HCMV_INFECTION_10HR_DN | 52 | 0.6207126 | 2.0289495 | 0 | 3.42E-04 | 0.042 | 3593 | tags = 54%, list = 18%, signal = 65% |
| DAVICIONI_TARGETS_OF_PAX_FOXO1_FUSIONS_DN | 61 | 0.5969014 | 2.0278313 | 0 | 3.47E-04 | 0.043 | 4649 | tags = 48%, list = 23%, signal = 61% |
| KANG_DOXORUBICIN_RESISTANCE_DN | 18 | 0.79531133 | 2.0267503 | 0 | 3.53E-04 | 0.044 | 2141 | tags = 72%, list = 10%, signal = 81% |
| LE_EGR2_TARGETS_UP | 104 | 0.55713445 | 2.0243058 | 0 | 3.66E-04 | 0.046 | 2650 | tags = 41%, list = 13%, signal = 47% |
| NAKAYAMA_SOFT_TISSUE_TUMORS_PCA2_UP | 83 | 0.56589115 | 2.0215824 | 0 | 3.87E-04 | 0.049 | 4319 | tags = 49%, list = 21%, signal = 62% |
| BENPORATH_ES_1 | 348 | 0.47813803 | 2.0215693 | 0 | 3.84E-04 | 0.049 | 4086 | tags = 45%, list = 20%, signal = 55% |

TABLE 8

| Gene | T47D_E2.beta | MCF7_E2.beta | DLDETOH.beta | HCT116_2_T18.beta | GBM_T21.beta |
| --- | --- | --- | --- | --- | --- |
| RGSL1 | −0.035539 | 0.079041 | 0.23102 | −0.02425 | 0.14929 |
| SLC3A2 | −0.79676 | −0.30297 | −0.20675 | −0.30946 | 0.016423 |
| GRHL2 | −1.0311 | −0.43799 | 0.11165 | 0.26511 | −0.088739 |
| CEP290 | −0.25392 | 0.30575 | 0.049784 | 0.072428 | 0.31366 |
| DDX60 | −0.43481 | 0.054966 | 0.33814 | 0.31551 | 0.35898 |
| BARD1 | −0.047138 | −0.62922 | −0.023674 | −0.013577 | −0.033814 |
| GATA3 | −1.4592 | −0.78496 | 0.23429 | 0.17492 | −0.077213 |
| LRCH3 | −0.31738 | 0.040221 | 0.12494 | 0.064119 | 0.15436 |
| ZNF451 | 0.27358 | 0.14424 | 0.2558 | 0.18442 | 0.070423 |
| MAGIX | 0.27129 | 0.21127 | 0.24321 | 0.2964 | 0.064116 |
| PAH | −0.25644 | 0.035206 | 0.22629 | 0.37075 | −0.054532 |
| CFI | 0.086014 | 0.024643 | −0.020676 | 0.076106 | −0.024063 |
| GFRA3 | −0.37053 | 0.088826 | 0.31966 | 0.018331 | −0.028966 |
| TOR2A | −0.2748 | −0.15505 | −0.038507 | 0.26977 | 0.041631 |
| SCG3 | 0.33673 | −0.16485 | 0.10291 | 0.16143 | 0.38674 |
| PLCZ1 | 0.14676 | 0.1438 | 0.16828 | 0.38984 | −0.012239 |
| CYLD | −0.17386 | 0.084952 | −0.19501 | −0.10355 | −0.074311 |
| PLD5 | 0.11977 | −0.068005 | 0.31164 | 0.072113 | 0.11303 |
| TROVE2 | −0.093568 | 0.22772 | 0.23296 | 0.3494 | 0.13574 |
| SGIP1 | 0.52169 | 0.14294 | 0.19883 | 0.10935 | 0.2892 |
| GNB4 | −0.13163 | −0.38387 | 0.19346 | 0.084122 | −0.079211 |
| PLEKHD1 | −0.035453 | −0.15761 | 0.15866 | 0.080694 | −0.05774 |
| AKT1 | −0.61632 | −0.32882 | −0.062195 | −0.18312 | −0.024661 |
| NME7 | 0.039567 | 0.18373 | 0.14743 | 0.40768 | 0.46323 |
| NCR2 | −0.13816 | −0.01847 | −0.11723 | 0.35843 | −0.058828 |
| PKHD1L1 | 0.063146 | 0.014669 | 0.20058 | 0.27302 | −0.093394 |
| GBGT1 | 0.022094 | −0.3 | 0.27318 | 0.16064 | 0.3698 |
| SLC25A13 | 0.59028 | 0.14615 | 0.2907 | 0.13296 | 0.16132 |
| PFKFB2 | −0.19228 | −0.41289 | 0.19562 | 0.30919 | 0.060893 |
| PROCA1 | −0.19135 | −0.97535 | −0.028682 | 0.16131 | −0.14679 |
| ATP11B | 0.11907 | 0.56832 | 0.21505 | −0.095064 | 0.27868 |
| PKD1 | −0.34382 | −0.45185 | 0.22619 | 0.19834 | −0.10994 |
| ATP1A4 | 0.16572 | −0.08123 | 0.090134 | 0.34622 | −0.069911 |
| TMEM108 | 0.081319 | −0.37762 | 0.025648 | −0.050347 | −0.058259 |
| MLLT11 | −0.24442 | −0.3321 | −0.058762 | 0.081572 | −0.15101 |
| RALGPSI | 0.28621 | 0.28997 | 0.25876 | 0.065073 | 0.19712 |
| CCBL2 | 0.051988 | −0.099011 | 0.18373 | 0.017368 | 0.22531 |
| TMEM184C | 0.14434 | −0.11642 | 0.12736 | 0.4587 | 0.057193 |
| KLHL8 | 0.23991 | 0.24824 | −0.047156 | 0.18862 | 0.31106 |
| GOLT1A | −0.098033 | −0.34592 | 0.044539 | 0.1847 | −0.0039787 |
| GAB1 | −0.35515 | −0.051392 | −0.088142 | 0.33193 | −0.05357 |
| MTMR2 | 0.21318 | 0.25622 | 0.019976 | 0.27754 | 0.031894 |
| PLXDCI | −0.26678 | 0.10941 | 0.060416 | 0.30588 | 0.087133 |
| RNF125 | −0.26582 | −0.098454 | 0.27144 | 0.081465 | 0.33735 |
| FXYD2 | −0.26688 | 0.034586 | 0.13078 | 0.04597 | 0.34824 |
| CAMKI | −0.13091 | 0.25553 | 0.17565 | 0.35651 | −0.085989 |
| TRAF5 | −0.13485 | 0.14594 | 0.20729 | 0.33775 | 0.27347 |
| MRS2 | 0.22396 | 0.1637 | 0.40759 | −0.053156 | 0.40791 |
| HECW2 | 0.3167 | −0.084904 | 0.38995 | 0.19673 | 0.35917 |
| NDUFA6 | −0.79977 | −0.0093232 | −0.60384 | −1.0174 | −0.73726 |
| CHMP4C | 0.11989 | −0.25767 | 0.31282 | 0.004185 | 0.13497 |
| CD300LF | −0.083313 | −0.27584 | 0.10132 | 0.15726 | −0.039622 |
| ATAD2 | −0.30048 | −0.14823 | −0.013221 | 0.16614 | −0.12611 |
| CACNG1 | −0.24407 | −0.3567 | 0.20662 | 0.012546 | 0.0093372 |
| EGFLAM | −0.032062 | 0.12887 | 0.15652 | 0.3 | 0.22039 |
| FBXW12 | −0.068572 | 0.079109 | 0.053679 | −0.062895 | 0.19951 |
| PTBP2 | 0.1238 | −0.44588 | −0.10894 | 0.11629 | 0.026333 |
| MICU1 | −0.16069 | 0.031438 | 0.38587 | −0.0006716 | 0.48392 |
| CYTH3 | −0.074849 | 0.20761 | −0.020816 | 0.053705 | 0.06947 |
| TLE1 | −0.19936 | 0.017119 | 0.22566 | 0.060163 | −0.030271 |
| SLC2A2 | 0.24827 | 0.33715 | 0.22278 | 0.34197 | 0.26041 |
| STAM | 0.088199 | −0.13432 | 0.052119 | 0.3226 | 0.056504 |
| KCNRG | −0.31592 | −0.53234 | 0.17133 | −0.25962 | −0.056156 |
| SEMA6A | 0.28404 | −0.045736 | 0.051967 | 0.030268 | 0.28072 |
| FNDC3B | −0.34559 | −0.31448 | −0.21829 | 0.092398 | 0.19541 |
| DCAF17 | 0.20135 | 0.30557 | 0.082453 | −0.094489 | 0.17515 |
| ZNF461 | −0.33824 | −0.18653 | −0.09767 | 0.36093 | 0.11168 |
| GIPC2 | 0.13162 | 0.15455 | −0.081768 | −0.060814 | 0.24932 |
| SCIN | −0.061701 | 0.001821 | 0.084262 | 0.54261 | −0.092934 |
| FCHSD2 | −0.046079 | 0.13795 | 0.38434 | 0.0062082 | 0.29729 |
| ERMAP | 0.2942 | 0.11486 | −0.18381 | 0.16372 | 0.0367 |
| FAM71D | −0.10204 | 0.0085961 | 0.05888 | 0.067324 | 0.20836 |
| MTM1 | −0.40976 | −0.26259 | 0.13317 | 0.1361 | 0.24181 |
| CHIA | 0.10797 | −0.018992 | 0.22977 | 0.40013 | −0.13459 |
| CUL5 | 0.14562 | 0.11002 | 0.32142 | 0.28262 | −0.1758 |
| UNC50 | −0.18324 | −0.32533 | −0.268 | −0.27191 | −0.16339 |
| C21orf2 | −0.42868 | 0.19088 | 0.074073 | 0.11162 | −0.036165 |
| ZSWIM2 | 0.099998 | 0.17741 | 0.10503 | 0.082721 | 0.27034 |

TABLE 8-continued

| | | | | | |
|---|---|---|---|---|---|
| GAS2 | −0.40476 | 0.0015749 | 0.24078 | −0.094591 | 0.26719 |
| IL13RA1 | −0.17638 | 0.30715 | 0.32088 | 0.23032 | 0.14403 |
| PUS10 | −0.11353 | 0.15867 | −0.17577 | 0.13822 | 0.04311 |
| DSE | 0.063962 | −0.21194 | −0.044761 | 0.24194 | 0.19393 |
| THBS3 | −0.46679 | −0.32766 | 0.23385 | 0.096231 | 0.30097 |
| TC2N | 0.043983 | 0.25266 | 0.07941 | 0.32231 | 0.10434 |
| CHIC2 | −0.21286 | −0.32452 | 0.10759 | 0.48429 | 0.17106 |
| ARRDC1 | 0.11332 | 0.31948 | 0.070829 | 0.10062 | −0.0025963 |
| SPATA22 | −0.10178 | 0.15966 | 0.0028108 | 0.37159 | 0.24894 |
| IGSF6 | −0.1273 | 0.10254 | 0.13413 | 0.261 | 0.19907 |
| TMEM248 | 0.069018 | −0.2821 | 0.1671 | 0.33631 | 0.20815 |
| RAG2 | 0.1876 | −0.16166 | 0.14179 | 0.47041 | 0.083424 |
| SLC25A16 | 0.016481 | 0.18343 | 0.10787 | 0.17979 | 0.11641 |
| PKN2 | −0.13329 | −0.36517 | 0.031539 | 0.075988 | −0.25601 |
| C2orf78 | −0.15 | 0.14479 | 0.091958 | 0.14524 | 0.1314 |
| PLEKHG4 | −0.27755 | 0.080881 | −0.045512 | 0.23806 | 0.09032 |
| CCDC30 | 0.3444 | −0.1265 | 0.11954 | −0.077904 | 0.12645 |
| STX6 | 0.23804 | −0.29407 | 0.28494 | 0.15459 | 0.12241 |
| NAGPA | 0.07253 | −0.22647 | −0.045318 | −0.27278 | 0.011807 |
| XPNPEP3 | −0.29951 | −0.27796 | 0.099427 | −0.40792 | −0.081932 |
| THAP2 | 0.14003 | −0.095244 | 0.036342 | 0.52212 | 0.17189 |
| PIBF1 | 0.15833 | −0.03631 | 0.077052 | 0.13262 | 0.22602 |
| GABRA4 | 0.1695 | 0.18944 | 0.098032 | 0.19417 | 0.22844 |
| CKAP2L | 0.11246 | −0.1603 | 0.016935 | −0.07183 | 0.057442 |
| REEP3 | −0.29645 | −0.14142 | 0.13354 | 0.14873 | 0.093157 |
| ARL5C | 0.033726 | 0.017564 | 0.32775 | 0.2714 | 0.025851 |
| LRRC42 | −0.17443 | 0.063249 | 0.050193 | 0.25499 | 0.14868 |
| HRG | −0.13284 | −0.36421 | 0.21891 | 0.12067 | 0.46592 |
| EPB41L4A | 0.14042 | 0.095117 | 0.18144 | 0.20354 | 0.15474 |
| ATF6 | 0.29799 | 0.078722 | 0.071008 | 0.10312 | −0.12725 |
| PANK2 | 0.079384 | 0.50458 | 0.11594 | 0.022399 | −0.019909 |
| NAF1 | −0.16352 | −0.28207 | −0.49379 | 0.12173 | −0.37736 |
| ARHGDIA | 0.058606 | −0.46034 | 0.081956 | 0.060687 | 0.1216 |
| ZNF175 | 0.12736 | 0.14732 | 0.17624 | 0.77995 | 0.23273 |
| VKORC1 | −0.19321 | −0.038292 | 0.080642 | 0.24351 | 0.17375 |
| MSH3 | 0.33471 | 0.15368 | 0.094934 | 0.075438 | 0.26882 |
| SLC26A2 | −0.12134 | 0.15098 | 0.13369 | 0.34352 | 0.10727 |
| CCDC6 | 0.22319 | 0.2749 | 0.20294 | 0.0088898 | 0.58036 |
| GXYLT1 | −0.41634 | 0.084256 | 0.28461 | 0.047495 | −0.52704 |
| DAAM2 | −0.13406 | 0.12957 | 0.43861 | 0.15947 | 0.26192 |
| ANO5 | −0.03539 | −0.27036 | 0.18434 | 0.08558 | 0.18905 |
| CYP24A1 | −0.067263 | −1.2432 | 0.23309 | −0.10503 | 0.17993 |
| UBXN7 | −0.01935 | 0.27415 | 0.56766 | 0.25587 | 0.19865 |
| C9orf43 | −0.25907 | 0.10141 | 0.1145 | 0.2657 | 0.054633 |
| CNTN6 | 0.009477 | 0.31635 | 0.094209 | 0.37474 | 0.081161 |
| LMLN | 0.31931 | 0.34334 | 0.19161 | −0.13939 | 0.40882 |
| METAP1D | 0.21558 | 0.082685 | 0.32898 | 0.23932 | 0.18948 |
| SEMA3D | 0.091737 | 0.35493 | 0.1172 | 0.00054551 | 0.1888 |
| ERGIC2 | 0.040774 | 0.29819 | −0.067124 | 0.17334 | −0.10057 |
| TM4SF1 | 0.16563 | 0.02033 | −0.079117 | 0.6622 | 0.30291 |
| ZCCHC11 | 0.24422 | 0.41272 | 0.13157 | 0.020316 | 0.18125 |
| ARHGEF12 | −0.158 | −0.01303 | 0.082891 | −0.10026 | 0.43679 |
| TMX4 | 0.1076 | −0.022373 | 0.39022 | 0.063179 | 0.15346 |
| UBN1 | −0.080603 | 0.3095 | 0.039202 | −0.041995 | 0.1033 |
| UPRT | 0.22122 | 0.21497 | 0.16111 | 0.12656 | −0.073418 |
| DAO | 0.13117 | 0.58355 | −0.076952 | 0.36027 | 0.12797 |
| GEN1 | −0.14734 | 0.27811 | 0.051219 | 0.060402 | −0.11203 |
| WDR31 | 0.051931 | −0.052642 | 0.090995 | 0.18502 | −0.044444 |
| TARBP1 | 0.15824 | −0.0063964 | 0.12338 | 0.25035 | −0.0036863 |
| TMED6 | 0.11909 | 0.15065 | 0.25918 | 0.26747 | 0.31987 |
| DLG2 | −0.20332 | −0.02392 | 0.17593 | 0.10705 | 0.50201 |
| FGD6 | −0.0018013 | 0.24176 | 0.30246 | 0.23661 | 0.48559 |
| OGN | −0.17663 | 0.060309 | −0.023291 | 0.30295 | −0.16397 |
| SLC6A3 | −0.21219 | 0.29186 | 0.29316 | 0.11077 | 0.12212 |
| GABRA2 | −0.19936 | −0.17264 | 0.26343 | 0.14442 | 0.41552 |
| CHRNA1 | −0.10324 | 0.14693 | 0.13637 | 0.15395 | 0.14023 |
| NPC1 | 0.36235 | −0.19492 | 0.27948 | 0.44328 | 0.038596 |
| GRSF1 | −0.74665 | −0.089487 | −0.25103 | −0.70281 | −0.4972 |
| CFTR | 0.32232 | 0.1039 | 0.38852 | 0.060963 | 0.33913 |
| LIPI | 0.045004 | 0.51616 | 0.013123 | −0.19358 | 0.34677 |
| SNX2 | 0.31857 | 0.38391 | 0.074677 | 0.045674 | −0.083875 |
| UGP2 | −0.1054 | 0.097745 | −0.11819 | −0.22379 | 0.07025 |
| LAMB3 | 0.023033 | 0.15702 | 0.13129 | 0.24148 | −0.31246 |
| IFT43 | −0.061188 | 0.4511 | 0.18279 | 0.11306 | 0.2104 |
| OPALIN | 0.034049 | 0.044764 | 0.056547 | −0.21906 | 0.2947 |
| SYCP1 | −0.34542 | −0.40661 | 0.065488 | 0.069192 | 0.31255 |
| TMEM106B | −0.12471 | −0.38006 | 0.28129 | 0.13986 | 0.15691 |
| ARHGAP26 | 0.15473 | 0.51524 | 0.14699 | 0.27274 | 0.34039 |
| GRIK1 | −0.0074415 | 0.02556 | 0.038754 | 0.33884 | 0.29488 |
| PKP4 | −0.23216 | −0.047313 | 0.55757 | 0.31762 | 0.25251 |

TABLE 8-continued

| | | | | | |
|---|---|---|---|---|---|
| R3HDM1 | 0.18163 | 0.29818 | 0.27469 | 0.16297 | 0.20143 |
| PP2R5B | −0.17031 | −0.29044 | 0.16188 | 0.1594 | −0.060416 |
| ATXN1L | −0.6201 | −0.35009 | 0.15427 | 0.13353 | 0.16456 |
| HMMR | 0.48879 | 0.34346 | 0.12502 | 0.051228 | 0.22935 |
| PNMAL1 | −0.21914 | −0.11346 | 0.10489 | 0.076409 | 0.36397 |
| EPYC | −0.20924 | 0.18735 | 0.13154 | 0.20566 | 0.20339 |
| NCCRP1 | −0.033064 | 0.099904 | 0.28792 | 0.27689 | 0.30058 |
| CARHSP1 | 0.030468 | 0.24145 | −0.034879 | −0.13225 | 0.52557 |
| C11orf49 | 0.081657 | 0.037211 | 0.15995 | 0.002622 | −0.1896 |
| KBTBD4 | 0.16563 | −0.031497 | −0.066311 | 0.3986 | −0.14181 |
| NME8 | 0.50116 | 0.076514 | −0.12915 | 0.33493 | 0.45466 |
| SWT1 | 0.18946 | −0.18547 | 0.15211 | 0.29589 | 0.24653 |
| BTBD11 | 0.20884 | −0.16783 | 0.24578 | 0.41024 | 0.005214 |
| FAM160B1 | 0.17759 | 0.11529 | 0.29546 | −0.081614 | 0.27547 |
| EFR3B | −0.056532 | 0.40461 | 0.15965 | 0.25735 | 0.090511 |
| CCDC90B | −0.075864 | 0.11136 | 0.12935 | −0.041628 | −0.15301 |
| HORMAD2 | −0.19066 | −0.24805 | −0.25752 | 0.07669 | 0.034841 |
| NOL4 | 0.10788 | 0.016943 | 0.25366 | 0.43304 | 0.47015 |
| CCDC129 | 0.051512 | 0.24537 | 0.24952 | 0.25677 | 0.19853 |
| POLN | 0.045471 | −0.098886 | 0.29758 | 0.16423 | 0.13372 |
| HADHB | 0.029495 | −0.0034115 | 0.15722 | 0.034535 | 0.51324 |
| ANKHD1 | −0.17476 | 0.15425 | 0.065936 | 0.46539 | 0.23615 |
| NUDT12 | −0.2117 | −0.14514 | −0.037602 | 0.12443 | 0.16315 |
| IL1RL2 | 0.16314 | 0.012994 | 0.042074 | 0.28949 | −0.0674 |
| NEK5 | 0.13936 | 0.25791 | −0.20128 | 0.3781 | 0.079684 |
| TAPT1 | −0.13193 | 0.17505 | 0.19135 | 0.12306 | 0.091656 |
| DPM2 | −0.00037379 | −0.061264 | −0.032253 | −0.3143 | −0.47836 |
| CCDC147 | −0.037097 | 0.084319 | 0.10041 | 0.32552 | 0.10573 |
| CHD2 | −0.05572 | −0.099115 | 0.20706 | −0.013663 | 0.1964 |
| PLD1 | −0.024413 | 0.0085055 | 0.068188 | 0.21984 | 0.20493 |
| FOXM1 | −0.18714 | −0.40525 | −0.33485 | −0.051706 | 0.0379 |
| CTDSPL | −0.34319 | −0.070413 | 0.034135 | 0.16688 | 0.14957 |
| ANKRD40 | −0.27775 | −0.27009 | −0.16348 | 0.10631 | 0.018311 |
| FAM206A | −0.23349 | −0.12849 | −0.07446 | 0.20454 | 0.0018143 |
| MCM8 | −0.028961 | 0.049671 | 0.098089 | 0.0070487 | 0.01973 |
| C5 | 0.16874 | 0.31991 | 0.25185 | 0.14772 | 0.30085 |
| PTPRZ1 | −0.21104 | −0.12732 | 0.15025 | 0.041326 | −0.018137 |
| ERI2 | 0.033125 | −0.018809 | 0.038778 | 0.29545 | 0.10767 |
| INA | 0.12808 | 0.029638 | 0.14743 | −0.1818 | −0.17201 |
| PYROXD2 | −0.20043 | 0.033194 | 0.084037 | 0.1277 | 0.12248 |
| MMP1 | 0.27719 | 0.20312 | 0.39831 | 0.11688 | 0.29336 |
| TTC13 | 0.0045156 | 0.39547 | 0.18664 | 0.17797 | 0.088307 |
| RGS7 | −0.092248 | 0.32547 | 0.27551 | 0.046193 | 0.52955 |
| EGR2 | −0.032222 | −0.039164 | 0.20323 | 0.33325 | 0.30093 |
| TRUB1 | −0.2084 | −0.14505 | 0.22731 | 0.33333 | 0.088714 |
| ERBB2 | −0.42036 | −0.00047578 | −0.12758 | 0.0095821 | 0.3129 |
| ARMC1 | −0.16586 | −0.24553 | 0.055536 | 0.022627 | 0.11407 |
| CACUL1 | −0.3719 | 0.068807 | −0.12318 | −0.062124 | −0.2034 |
| UBE2B | 0.020958 | 0.16181 | 0.37491 | −0.066009 | 0.32772 |
| LRRK2 | −0.014128 | 0.17874 | 0.10363 | 0.22613 | 0.32133 |
| KCNH5 | 0.20063 | 0.021829 | 0.159 | 0.31203 | 0.089496 |
| FETUB | −0.28137 | −0.057013 | 0.33939 | 0.34328 | 0.032029 |
| PRKAG1 | −0.031024 | 0.19854 | 0.29767 | 0.074983 | 0.072234 |
| APH1A | 0.094279 | −0.030268 | 0.1905 | 0.47475 | 0.23268 |
| ZMYM2 | 0.040646 | −0.44482 | 0.10238 | 0.097434 | 0.13848 |
| RALGAPA2 | −0.204 | 0.32555 | 0.036414 | 0.34639 | 0.41447 |
| AFMID | −0.12426 | −0.26108 | 0.023092 | 0.58099 | 0.20346 |
| RBL2 | 0.50811 | 0.45323 | 0.092556 | 0.12715 | 0.30812 |
| EFCAB7 | 0.032208 | −0.13935 | −0.00075794 | 0.15202 | 0.47202 |
| RAB3IP | −0.038401 | −0.21391 | 0.28558 | 0.16723 | 0.034446 |
| TEDDM1 | −0.16322 | 0.19941 | 0.13249 | −0.13105 | 0.27387 |
| DDHD2 | 0.0012597 | 0.32176 | 0.17645 | 0.39349 | 0.12817 |
| CHMP7 | −0.187 | −0.049719 | 0.15912 | 0.10736 | 0.08942 |
| CTSE | 0.12932 | −0.16954 | 0.27821 | 0.44155 | −0.079561 |
| TRPC6 | −0.3442 | 0.12331 | −0.11851 | 0.11779 | 0.11855 |
| BBS5 | 0.2671 | 0.0001617 | 0.22522 | 0.14734 | 0.0096579 |
| IFT52 | −0.22393 | 0.057866 | 0.03897 | 0.26214 | 0.22736 |
| SEMA3E | 0.18508 | 0.49552 | 0.14338 | 0.44173 | 0.12214 |
| NRD1 | −0.45015 | −0.3438 | −0.0031464 | 0.09454 | 0.086135 |
| ZDHHC4 | −0.077603 | 7.92E−05 | 0.078736 | 0.20167 | 0.028339 |
| MIA2 | −0.16254 | −0.01354 | 0.14716 | 0.2043 | 0.4159 |
| PARP11 | 0.11465 | 0.32114 | −0.01095 | 0.059104 | −0.00449 |
| POU2F1 | −0.31231 | −0.10035 | 0.039036 | −0.4086 | 0.079967 |
| BAG5 | 0.019102 | 0.22396 | −0.034906 | −0.15866 | −0.047031 |
| HYDIN | −0.21711 | −0.18562 | 0.034739 | 0.22596 | −0.0075943 |
| PIK3C2A | 0.24007 | −0.20204 | 0.38415 | 0.53861 | 0.046765 |
| ADAMTS18 | 0.15434 | −0.13138 | 0.38694 | −0.06091 | 0.04561 |
| DQX1 | 0.096318 | −0.074857 | 0.080172 | 0.23562 | 0.30514 |
| SYPL1 | 0.13294 | 0.15478 | 0.30893 | 0.34252 | −0.00082743 |
| ALKBH3 | 0.036759 | −0.01068 | 0.18184 | 0.070712 | 0.25193 |

TABLE 8-continued

| | | | | | |
|---|---|---|---|---|---|
| TMEM233 | −0.20357 | 0.1727 | 0.14076 | 0.048204 | 0.19197 |
| CD3D | 0.08698 | 0.23137 | 0.20915 | 0.16649 | 0.35088 |
| SCN9A | 0.19721 | 0.35201 | 0.15268 | 0.44125 | 0.14849 |
| PHACTR4 | 0.35056 | 0.27623 | 0.15552 | −0.080998 | 0.27612 |
| IFT74 | −0.076001 | 0.41517 | 0.16922 | 0.093479 | 0.24664 |
| CCDC83 | 0.028579 | 0.039111 | 0.052546 | 0.54709 | 0.40494 |
| FBXL2 | 0.25928 | 0.11999 | 0.22496 | 0.1185 | 0.18431 |
| NLRP9 | −0.39283 | −0.24551 | 0.0077705 | 0.082469 | 0.025787 |
| LYPD6B | 0.067933 | −0.30489 | 0.1531 | 0.048493 | −0.078839 |
| CPEB2 | 0.087692 | 0.0074646 | 0.11511 | 0.075409 | 0.40857 |
| ITPR2 | 0.15678 | 0.14299 | 0.18958 | 0.15518 | 0.24763 |
| ALPK2 | −0.042242 | 0.29334 | 0.40774 | 0.46301 | 0.22808 |
| GLG1 | 0.28628 | 0.13309 | 0.38264 | 0.36829 | 0.10054 |
| ABCG2 | −0.008539 | 0.20187 | 0.13342 | 0.02937 | 0.2289 |
| SYNE3 | 0.13525 | 0.19932 | 0.43503 | 0.33446 | 0.38285 |
| CCR4 | 0.10326 | −0.02778 | 0.084124 | 0.069592 | 0.28885 |
| ERN2 | −0.067426 | −0.37504 | 0.088677 | 0.092429 | 0.11086 |
| SUFU | 0.060452 | −0.0034162 | 0.29054 | −0.14932 | 0.23998 |
| FAM19A2 | 0.0053013 | −0.12451 | 0.16101 | 0.090587 | 0.36457 |
| ELTD1 | 0.09242 | 0.10247 | 0.22116 | 0.16581 | 0.45114 |
| LINGO4 | −0.26557 | −0.3009 | 0.26438 | 0.14841 | 0.20712 |
| STXBP5L | −0.01232 | 0.0098701 | 0.22492 | 0.038313 | 0.29071 |
| NUMB | −0.15486 | −0.091682 | 0.16261 | 0.19911 | −0.040351 |
| GK | 0.067899 | 0.14224 | 0.30136 | 0.2378 | 0.28267 |
| FAM49A | 0.46009 | −0.061739 | −0.056405 | 0.3458 | 0.26236 |
| NRCAM | −0.24995 | −0.18892 | 0.045171 | 0.085473 | 0.12791 |
| XPO4 | −0.09105 | −0.17251 | 0.031502 | 0.071644 | 0.3886 |
| ICA1L | −0.33867 | −0.11687 | 0.076548 | 0.32942 | 0.2398 |
| CNTRL | 0.10407 | 0.28946 | 0.14824 | 0.069941 | −0.042466 |
| HIVEP1 | 0.038673 | −0.15808 | 0.22332 | 0.19698 | 0.33455 |
| ZMYND15 | −0.055727 | 0.26097 | 0.073153 | 0.34121 | 0.13908 |
| SLC35G2 | 0.08956 | −0.0065971 | 0.37918 | 0.061227 | 0.092814 |
| SLC27A2 | 0.091887 | −0.5265 | 0.12279 | 0.22861 | 0.21843 |
| IL6 | 0.066876 | 0.30623 | 0.28445 | 0.033387 | 0.095808 |
| ALDH6A1 | 0.29653 | 0.022622 | 0.10739 | 0.12577 | −0.0032311 |
| C7orf61 | −0.069652 | −0.061516 | 0.26214 | 0.010678 | −0.4742 |
| PRKAA2 | −0.067106 | 0.32411 | 0.078071 | 0.0076385 | −0.048866 |
| PHPT1 | −0.44159 | −0.10162 | 0.1772 | 0.031898 | 0.19968 |
| COLEC10 | 0.069931 | −0.26789 | 0.36747 | 0.041499 | 0.02695 |
| TDP1 | 0.11989 | 0.10307 | 0.22336 | 0.23263 | 0.00091415 |
| HOOK1 | 0.31305 | 0.18234 | 0.29428 | 0.12593 | 0.23739 |
| PDZD9 | −0.19163 | −0.068174 | 0.079336 | −0.080063 | 0.31365 |
| ODC1 | 0.45615 | 0.11376 | 0.25903 | 0.0093133 | 0.0089197 |
| TMEM116 | 0.32933 | 0.075748 | 0.3647 | 0.058746 | −0.11609 |
| CERS2 | −0.10818 | −0.048924 | −0.21033 | −0.00021923 | 0.23864 |
| IFI27 | −0.088868 | −0.034758 | 0.11316 | 0.039854 | 0.23545 |
| PPP1R36 | −0.093345 | −0.00018499 | −0.025082 | 0.013126 | −0.055161 |
| CAPN2 | −0.25891 | −0.30535 | 0.16161 | 0.13488 | 0.41132 |
| CYBA | 0.075594 | −0.11086 | 0.11551 | 0.17812 | 0.19265 |
| CHRNB3 | 0.026927 | −0.095427 | 0.18954 | −0.072619 | 0.28498 |
| SYT14 | 0.099213 | 0.087319 | 0.19137 | 0.010119 | 0.17655 |
| SLITRK3 | −0.19621 | −0.19829 | 0.037106 | −0.1491 | 0.28766 |
| SEC22A | 0.028977 | 0.10294 | 0.19832 | 0.44436 | −0.163 |
| GCC2 | 0.49211 | 0.14387 | 0.16596 | 0.19044 | 0.30191 |
| BBS2 | −0.014282 | −0.26274 | 0.0050112 | −0.076244 | 0.26992 |
| CKLF | −0.026945 | −0.030731 | 0.2828 | 0.12351 | 0.24451 |
| AVL9 | −0.19109 | 0.12641 | 0.093226 | −0.072607 | 0.35744 |
| UBL7 | 0.057317 | −0.14655 | 0.26522 | 0.27105 | 0.32781 |
| AURKC | −0.038735 | −0.11501 | 0.060537 | 0.30707 | 0.31809 |
| TLE2 | −0.0004788 | 0.012496 | 0.024982 | 0.28872 | 0.14724 |
| CLPX | 0.054728 | 0.32881 | 0.1777 | −0.0094912 | 0.39438 |
| ZHX3 | −0.24378 | 0.17932 | 0.25899 | 0.043811 | −0.078491 |
| SUGP2 | −0.049157 | −0.0042436 | −0.091204 | −0.12465 | −0.22858 |
| ST6GALNAC2 | 0.057786 | 0.065996 | 0.10958 | −0.06785 | −0.19383 |
| CMYA5 | −0.10892 | −0.099535 | 0.21874 | 0.058475 | 0.13354 |
| SERPINB7 | 0.35231 | 0.30196 | 0.15712 | 0.090737 | 0.23431 |
| USP6NL | −0.20525 | 0.047639 | 0.12054 | −0.0027335 | 0.16019 |
| C11orf48 | −0.10795 | −0.174 | −0.16785 | 0.21418 | 0.044009 |
| FGF8 | −0.013931 | 0.022369 | 0.00029359 | 0.52778 | 0.078121 |
| STX3 | 0.14321 | 0.061185 | 0.13184 | 0.15916 | 0.35851 |
| IL17RD | 0.39699 | −0.06543 | 0.26872 | 0.24789 | 0.11447 |
| TLL2 | −0.40851 | 0.19676 | −0.041726 | 0.045191 | 0.15062 |
| PCSK5 | 0.27804 | 0.10221 | 0.15074 | 0.025141 | 0.30349 |
| CDH19 | 0.20019 | 0.033381 | 0.16857 | 0.037738 | 0.61678 |
| TM2D3 | 0.086549 | −0.00058684 | −0.011468 | 0.13203 | −0.086488 |
| TCTE3 | −0.013682 | 0.1028 | 0.069624 | 0.031079 | 0.12642 |
| ZNF776 | 0.11721 | 0.54239 | 0.25941 | 0.09098 | 0.24593 |
| RAB21 | 0.34474 | −0.14885 | −0.072383 | 0.27395 | −0.30007 |
| AP4E1 | −0.29201 | −0.12882 | 0.049869 | −0.29695 | 0.19223 |
| PPIB | 0.24746 | −0.13232 | 0.066535 | −0.095694 | 0.080666 |

TABLE 8-continued

| | | | | | |
|---|---|---|---|---|---|
| TEX261 | −0.11476 | 0.025894 | 0.037072 | 0.15228 | 0.1923 |
| ACER3 | 0.3359 | 0.19025 | 0.21465 | 0.13323 | 0.17951 |
| CNTD2 | 0.2119 | 0.39911 | 0.24135 | 0.38764 | 0.22699 |
| STARD9 | 0.070497 | −0.097723 | 0.25866 | 0.2933 | 0.035681 |
| TRIM69 | 0.24967 | 0.14854 | 0.097909 | 0.028326 | 0.22116 |
| PAK2 | −0.018256 | −0.11225 | 0.15274 | 0.37615 | 0.078276 |
| SIT1 | 0.27362 | 0.16022 | 0.073561 | 0.12539 | −0.028773 |
| AKAP9 | 0.057316 | 0.23336 | 0.16617 | 0.15885 | 0.29399 |
| ARFIP2 | −0.032155 | −0.089523 | 0.15416 | −0.085341 | 0.34749 |
| EXD2 | 0.27919 | 0.092365 | 0.276 | 0.13118 | 0.3358 |
| MAPKAPK5 | 0.049706 | 0.068085 | 0.18094 | 0.10439 | 0.19287 |
| RAB5B | −0.013648 | 0.074628 | 0.26703 | 0.094514 | 0.18309 |
| CASP6 | 0.24124 | 0.11026 | 0.13292 | 0.080687 | 0.16758 |
| PDZRN3 | 0.17174 | 0.083258 | 0.15186 | 0.38037 | 0.63354 |
| FAM126B | 0.15557 | −0.12989 | 0.28634 | 0.30856 | 0.23126 |
| BAZ2B | −0.00051277 | −0.18122 | 0.064654 | 0.17055 | 0.087224 |
| SOAT2 | −0.24503 | −0.36939 | 0.063025 | 0.32471 | 0.25808 |
| ZNF311 | −0.020947 | 0.20137 | 0.16952 | 0.36509 | 0.22355 |
| ERBB2IP | 0.37046 | 0.62784 | −0.051134 | −0.033532 | −0.070371 |
| PPP2R5A | 0.15521 | 0.041382 | 0.13359 | 0.084131 | 0.22604 |
| PLS3 | 0.090524 | 0.17552 | 0.35246 | 0.28551 | 0.0046782 |
| FSD2 | 0.13011 | 0.059285 | −0.1236 | 0.25201 | 0.11808 |
| MAMDC4 | 0.10845 | 0.077507 | 0.11125 | −0.0084911 | 0.16283 |
| TCFL5 | 0.13675 | −0.1208 | 0.33005 | 0.25573 | −0.13156 |
| KDM5B | −0.13165 | 0.028353 | 0.23127 | −0.014982 | −0.015692 |
| PALMD | 0.26704 | 0.13991 | 0.40339 | −0.0028171 | 0.23196 |
| PXDNL | 0.20467 | 0.24385 | 0.11412 | 0.13451 | 0.19277 |
| COL11A1 | 0.16427 | 0.35809 | 0.40129 | 0.30295 | 0.3898 |
| CLMP | 0.10423 | 0.11756 | 0.22607 | −0.034398 | −0.27117 |
| CPN2 | −0.19437 | 0.22455 | 0.21356 | 0.42443 | −0.10723 |
| ADAM28 | 0.26224 | 0.10041 | 0.13524 | 0.34282 | 0.28411 |
| FBXO7 | 0.15461 | 0.22137 | 0.1587 | 0.0038092 | 0.11749 |
| UTS2 | −0.083075 | −0.093445 | 0.030043 | 0.29915 | 0.4844 |
| ZFR | −0.083425 | −0.05204 | −0.070472 | 0.26054 | −0.226 |
| GOLPH3L | −0.09655 | 0.19123 | 0.021546 | 0.37206 | 0.17696 |
| SLC25A21 | 0.0064616 | 0.1121 | 0.16013 | 0.28124 | 0.28452 |
| SLIRP | −0.091431 | −0.0025837 | −0.28404 | −0.14783 | 0.076544 |
| ANKRD28 | 0.035923 | 0.019647 | 0.27137 | 0.024126 | 0.15975 |
| EPC1 | 0.18303 | 0.13344 | 0.15706 | 0.23611 | 0.15566 |
| VPS26B | −0.33395 | −0.097937 | 0.48688 | −0.037752 | 0.16031 |
| PP2D1 | 0.31818 | 0.23181 | 0.22696 | 0.27736 | 0.34485 |
| TIGD6 | 0.37085 | 0.057286 | 0.1867 | 0.18186 | 0.16867 |
| MASP1 | 0.049703 | −0.11215 | 0.28889 | 0.2027 | 0.5726 |
| HGF | 0.23573 | 0.22921 | 0.27601 | 0.368 | −0.046709 |
| KTN1 | 0.094107 | 0.1016 | 0.28812 | 0.20689 | 0.20284 |
| COL25A1 | 0.14171 | −0.26721 | 0.18173 | 0.36977 | 0.23226 |
| MMP8 | −0.046928 | −0.1339 | 0.1311 | 0.087351 | 0.11491 |
| ATP11C | 0.37254 | 0.24999 | 0.39691 | 0.38118 | 0.21364 |
| FGB | −0.14616 | 0.32341 | 0.31002 | 0.079055 | 0.2413 |
| CAPN3 | 0.0095609 | −0.1079 | −0.059944 | −0.073869 | 0.13966 |
| SLC41A2 | −0.06956 | 0.26635 | 0.041923 | −0.046299 | 0.43558 |
| CEP41 | 0.33585 | 0.31615 | 0.29271 | 0.10883 | 0.27221 |
| PRRX2 | 0.24767 | 0.28356 | 0.21174 | 0.19649 | 0.068354 |
| SPICE1 | 0.2162 | 0.060638 | 0.16846 | 0.2688 | 0.35105 |
| RASSF3 | 0.097238 | 0.091709 | 0.13074 | 0.20256 | 0.11537 |
| ANO10 | 0.095198 | 0.074669 | 0.2383 | 0.31063 | 0.43458 |
| PEX11B | 0.088627 | 0.066334 | 0.19015 | 0.049392 | 0.084099 |
| GOLGA4 | 0.20969 | 0.28135 | 0.18085 | −0.28015 | 0.58642 |
| RNF130 | −0.33401 | −0.24759 | 0.19196 | 0.47147 | 0.20846 |
| MS4A10 | 0.083442 | 0.29233 | 0.078797 | 0.074034 | 0.50964 |
| SNX10 | −0.058623 | −0.13991 | −0.20391 | 0.24055 | 0.16966 |
| POLB | −0.030801 | 0.055031 | 0.22022 | 0.38218 | 0.42334 |
| XYLB | 0.28509 | 0.23512 | 0.076177 | 0.50149 | −0.18578 |
| BCL2L11 | 0.27023 | 0.12123 | 0.10514 | 0.17674 | −0.091493 |
| SPAG1 | 0.34964 | 0.21566 | 0.19238 | 0.14531 | 0.15973 |
| HS2ST1 | 0.02811 | 0.1243 | 0.24849 | 0.27338 | 0.27798 |
| LRTOMT | −0.19484 | 0.0097548 | 0.14217 | 0.64139 | 0.085821 |
| HCN1 | −0.35732 | 0.038624 | 0.01742 | 0.043928 | 0.14083 |
| MCHR2 | −0.294 | 0.14899 | −0.047031 | 0.32628 | 0.17502 |
| CSNK2A2 | −0.34684 | 0.16962 | 0.25245 | 0.2603 | 0.392 |
| XKRX | 0.1876 | 0.050077 | 0.14843 | 0.25061 | 0.2142 |
| IFI16 | −0.22366 | 0.43393 | −0.11217 | 0.3854 | 0.087427 |
| KRT20 | 0.27757 | 0.24882 | 0.19676 | 0.02331 | 0.22725 |
| CA11 | 0.3432 | −0.23754 | −0.030666 | −0.070804 | −0.2324 |
| APOH | −0.17926 | 0.14288 | 0.18086 | 0.030341 | 0.37374 |
| SCNN1G | −0.0452 | 0.25358 | 0.25802 | 0.19955 | 0.42226 |
| CCDC169 | −0.088638 | −0.051273 | −0.10167 | 0.28687 | 0.4059 |
| SLC31A2 | −0.20109 | 0.05667 | −0.071225 | 0.48038 | −0.12306 |
| TSC22D2 | −0.11377 | −0.046216 | 0.37697 | 0.35228 | −0.25665 |
| HERC6 | 0.45308 | 0.094003 | 0.1361 | 0.11646 | −0.046404 |

TABLE 8-continued

| | | | | | |
|---|---|---|---|---|---|
| TRANK1 | 0.04747 | 0.15714 | 0.032386 | 0.043118 | 0.030856 |
| SLC35B4 | −0.010975 | 0.074826 | 0.25129 | 0.24451 | 0.076518 |
| TMX3 | 0.1362 | 0.16136 | −0.02642 | 0.20796 | 0.06874 |
| LCN15 | −0.3008 | 0.0074871 | 0.062971 | 0.15786 | 0.21102 |
| IRF2 | 0.27395 | 0.43877 | 0.28345 | 0.15459 | 0.32573 |
| NFAM1 | 0.2589 | 0.1128 | 0.00094867 | 0.27275 | 0.26507 |
| PAM | 0.13714 | 0.45536 | 0.057668 | −0.024499 | −0.027174 |
| IVNS1ABP | −0.099355 | −0.080291 | −0.1114 | 0.38042 | 0.19176 |
| ADK | 0.096214 | 0.39199 | 0.28057 | −0.060477 | −0.06596 |
| ELOVL4 | 0.30916 | 0.092593 | 0.080484 | 0.43042 | −0.019995 |
| AMOT | −0.17823 | 0.19396 | 0.38278 | 0.24557 | 0.031904 |
| LAMA2 | −0.20946 | −0.19236 | 0.1729 | 0.68711 | 0.059938 |
| ARF5 | −0.15642 | 0.12248 | −0.15191 | 0.32155 | 0.029291 |
| VWA3A | −0.035563 | −0.062158 | 0.17275 | 0.027221 | 0.21798 |
| PIK3R1 | −0.11693 | −0.12887 | 0.11401 | 0.29125 | 0.47734 |
| RORC | 0.059889 | 0.20219 | 0.017721 | 0.16458 | −0.042693 |
| N6AMT2 | −0.17347 | 0.2091 | 0.18673 | 0.27233 | −0.054655 |
| FGF1 | −0.14746 | 0.042079 | 0.0787 | 0.064827 | −0.34352 |
| THBS1 | 0.19096 | −0.1279 | 0.20902 | 0.12121 | 0.080952 |
| TDRD10 | 0.070484 | 0.020425 | 0.10423 | 0.092692 | 0.094197 |
| SLC38A1 | 0.082098 | −0.068937 | 0.063613 | 0.37762 | 0.12949 |
| IGSF10 | 0.18693 | −0.093541 | 0.19293 | 0.23373 | 0.44826 |
| RALGPS2 | 0.096047 | 0.49815 | 0.31138 | −0.06846 | 0.01603 |
| C14orf166B | −0.35026 | 0.00086567 | 0.087683 | 0.30258 | −0.10451 |
| LBP | −0.32784 | −0.016483 | −0.076464 | 0.19978 | 0.082867 |
| SOAT1 | 0.24567 | 0.42369 | 0.23803 | 0.17028 | 0.32324 |
| PPAPDC1B | −0.38107 | −0.11406 | 0.10048 | 0.37967 | 0.11823 |
| MTF2 | −0.0372 | 0.18013 | 0.12109 | 0.093234 | 0.3474 |
| ST5 | 0.015269 | −0.0067039 | 0.17767 | −0.11733 | 0.33625 |
| ANGPTL3 | −0.10348 | −0.075703 | 0.31155 | −0.0097993 | 0.35396 |
| SUMO3 | −0.19961 | 0.10627 | 0.17268 | 0.36846 | −0.16479 |
| ZIM3 | 0.094098 | −0.078521 | 0.25174 | 0.078975 | 0.064375 |
| GDPD1 | −0.14637 | −0.27352 | 0.1211 | 0.147 | 0.20093 |
| MAGED2 | 0.24994 | 0.29027 | 0.26712 | 0.27725 | 0.30886 |
| HNRNPUL2 | −0.22651 | 0.024636 | 0.034988 | 0.18051 | −0.17317 |
| CHN1 | 0.19602 | 0.4643 | 0.17367 | 0.0091083 | 0.039618 |
| GBE1 | 0.040453 | 0.15051 | 0.042216 | 0.080354 | −0.10872 |
| LRRC16B | 0.26355 | 0.58225 | 0.13482 | 0.19066 | −0.036577 |
| YWHAH | 0.10859 | 0.038858 | 0.048721 | 0.073699 | 0.041547 |
| DZANK1 | −0.10362 | 0.049636 | 0.27736 | −0.032633 | 0.25195 |
| C7orf10 | −0.18826 | −0.18505 | 0.067855 | 0.3918 | −0.41888 |
| AEBP2 | −0.44643 | −0.024713 | 0.15847 | 0.43323 | 0.082285 |
| RBMS3 | 0.18629 | 0.2449 | 0.26181 | 0.13094 | 0.072016 |
| TRMT11 | 0.21371 | −0.012625 | −0.2644 | −0.16038 | −0.31304 |
| NOA1 | −0.12553 | −0.28032 | −0.21348 | −0.093602 | −0.1093 |
| SPATA6 | 0.0073865 | 0.11855 | −0.014625 | −0.019267 | 0.053019 |
| NUDT14 | −0.11086 | −0.087189 | −0.064904 | 0.25884 | 0.079812 |
| PRICKLE2 | 0.21966 | −0.6402 | 0.085519 | 0.11027 | 0.043785 |
| SNRK | −0.0366 | −0.15282 | 0.027996 | 0.12367 | 0.42623 |
| ZC3HAV1 | −0.0078533 | −0.13117 | 0.20328 | 0.34303 | −0.16723 |
| GPRC5B | 0.15773 | 0.021546 | 0.22012 | 0.29744 | 0.36387 |
| SLC7A13 | −0.059749 | 0.18206 | 0.17374 | 0.44124 | −0.085129 |
| MYO3B | −0.15102 | 0.011148 | 0.28533 | 0.32536 | 0.21918 |
| TOP1MT | −0.47952 | −0.31453 | 0.098736 | 0.1318 | −0.40956 |
| GNPAT | −0.10817 | 0.031839 | −0.16951 | 0.097996 | −0.089279 |
| TBC1D12 | 0.019346 | 0.08204 | −0.088623 | 0.24411 | 0.13563 |
| C11orf31 | −0.018781 | 0.1384 | 0.088728 | 0.17988 | 0.10759 |
| TRPC4AP | 0.25047 | 0.40914 | 0.11312 | −0.0046873 | 0.12273 |
| ATP13A3 | −0.15017 | 0.40219 | 0.21266 | 0.26603 | 0.46891 |
| IFT46 | −0.090583 | −0.14254 | 0.19578 | 0.2352 | −0.058382 |
| AKAP7 | −0.18497 | 0.033218 | −0.021082 | 0.0072082 | 0.088874 |
| C6orf211 | 0.010284 | −0.3355 | 0.1699 | −0.091744 | 0.35588 |
| PPP1R14C | 0.036803 | −0.0091552 | 0.04399 | −0.05474 | 0.052849 |
| ZNF165 | 0.25106 | −0.19467 | 0.028344 | 0.0071747 | 0.27662 |
| DLG1 | 0.12982 | 0.14376 | 0.17933 | −0.18258 | 0.24517 |
| ACOXL | 0.12783 | −0.051116 | 0.16914 | −0.12885 | −0.023006 |
| MSH4 | 0.078117 | 0.35986 | 0.056537 | 0.38637 | 0.12184 |
| RANBP10 | −0.3604 | 0.39775 | −0.1527 | 0.30057 | 0.012982 |
| DESI1 | −0.035136 | 0.17194 | −0.087635 | −0.18117 | 0.012041 |
| DENND4C | −0.16041 | −0.17739 | −0.10456 | 0.02974 | 0.31251 |
| AFF2 | 0.063301 | 0.2176 | 0.20946 | 0.49226 | 0.15153 |
| KCNT2 | 0.33918 | 0.45244 | 0.23913 | 0.33936 | −0.2127 |
| NUDT13 | −0.030606 | −0.12701 | 0.17412 | 0.43596 | 0.01848 |
| VRK2 | 0.17562 | 0.095465 | 0.11935 | 0.14292 | 0.38214 |
| SLC30A7 | −0.014691 | 0.11957 | −0.10001 | 0.073294 | 0.072441 |
| SAMD9L | −0.042123 | −0.11495 | 0.24294 | 0.28745 | −0.063532 |
| CDH18 | −0.093903 | −0.079337 | 0.048787 | 0.3874 | 0.3366 |
| GLT8D2 | −0.072499 | 0.10901 | −0.018199 | 0.32087 | −0.057591 |
| MFI2 | −0.37691 | −0.038926 | 0.21701 | 0.19122 | −0.17437 |
| MUSTN1 | −0.083354 | −0.34982 | 0.20677 | 0.78744 | 0.014844 |

TABLE 8-continued

| | | | | | |
|---|---|---|---|---|---|
| MPZ | −0.2563 | 0.065297 | −0.021037 | −0.061844 | 0.13707 |
| MANSC4 | 0.21056 | 0.15715 | 0.11548 | 0.1866 | 0.27217 |
| IQUB | −0.20663 | 0.15516 | −0.019345 | −0.11288 | 0.19169 |
| PPM1H | −0.17899 | −0.11244 | 0.15298 | −0.030216 | 0.062875 |
| TCTN3 | −0.0045533 | 0.085717 | 0.18751 | −0.13452 | 0.21996 |
| ERLEC1 | 0.1731 | −0.046851 | −0.17995 | −0.10646 | 0.19037 |
| TMEM64 | −0.34073 | −0.35605 | −0.025535 | −0.0054198 | −0.21315 |
| ATP6V0A1 | 0.032358 | 0.075474 | −0.12318 | −0.014842 | −0.075746 |
| CD80 | 0.20815 | 0.096983 | 0.29582 | 0.30701 | 0.34908 |
| FUZ | 0.017254 | −0.22777 | 0.022214 | 0.33491 | −0.35706 |
| DGKH | −0.065791 | 0.16745 | −0.072232 | −0.24101 | 0.16692 |
| TOMM20L | 0.0524 | 0.11921 | −0.178 | −0.051021 | −0.080907 |
| UBQLN1 | 0.30038 | −0.037987 | 0.025325 | 0.066738 | 0.062244 |
| GTF2A1L | 0.36614 | 0.024819 | 0.061903 | 0.42239 | 0.25022 |
| CNGB1 | 0.31459 | 0.24274 | −0.14337 | 0.13049 | 0.23375 |
| PLBD1 | 0.12706 | −0.2507 | 0.25186 | 0.098224 | −0.1335 |
| TRIP11 | −0.23301 | −0.24255 | 0.24078 | −0.22685 | 0.16382 |
| ARID4B | −0.28282 | 0.19338 | 0.5174 | −0.061967 | 0.35051 |
| GMNC | −0.059138 | 0.22062 | 0.22469 | 0.57408 | 0.20731 |
| STRA13 | 0.030122 | −0.26126 | −0.038552 | 0.0057995 | −0.29191 |
| CMTM3 | −0.34394 | −0.045771 | 0.089308 | 0.16576 | 0.31426 |
| ANKRD13A | −0.044075 | 0.19884 | 0.065792 | −0.041128 | 0.035161 |
| NPHP3 | 0.48441 | −0.038742 | 0.11227 | 0.076501 | 0.35613 |
| PI4K2A | −0.62056 | 0.014557 | 0.13439 | 0.21574 | 0.18495 |
| ARV1 | 0.0074706 | 0.084687 | 0.17066 | 0.3686 | −0.051353 |
| EXOC6B | −0.12771 | 0.12053 | 0.017844 | 0.17452 | 0.34171 |
| SCD5 | −0.14303 | 0.24171 | 0.20175 | 0.045687 | 0.28059 |
| ACCSL | 0.15956 | 0.33845 | 0.28016 | 0.24007 | 0.015144 |
| RNF145 | 0.17632 | 0.30739 | 0.20303 | 0.48355 | −0.12329 |
| SPATS1 | −0.48638 | −0.15432 | −0.23259 | −0.21507 | 0.36337 |
| ATP1B4 | 0.1266 | 0.22892 | 0.2718 | 0.35225 | −0.0092513 |
| FOXF2 | −0.068127 | 0.28163 | 0.25284 | −0.0031304 | 0.10894 |
| TTBK2 | 0.064639 | 0.26153 | 0.24252 | 0.51122 | 0.11253 |
| INSL3 | 0.11816 | −0.23828 | 0.17878 | 0.36983 | 0.073615 |
| C9orf84 | 0.15802 | 0.18148 | −0.19224 | 0.35781 | −0.083221 |
| AMPD3 | 0.064659 | 0.17049 | 0.013557 | −0.25652 | 0.015041 |
| DENND5B | 0.062746 | −0.050397 | 0.11274 | 0.48784 | 0.32226 |
| RSRC2 | −0.07565 | −0.35119 | −0.3254 | −0.29334 | 0.081553 |
| HHATL | −0.105 | 0.28017 | 0.0076074 | 0.16717 | −0.15802 |
| APOBEC1 | 0.27985 | 0.33768 | 0.061095 | 0.27989 | 0.25734 |
| ABCF3 | −0.067882 | 0.27717 | 0.39508 | 0.068887 | 0.42879 |
| TNFAIP3 | −0.098426 | −0.071336 | 0.17348 | 0.16961 | −0.060023 |
| UBXN1 | −0.35331 | −0.083383 | −0.14669 | −0.036176 | −0.08025 |
| MYH1 | −0.29454 | −0.042219 | 0.27977 | −0.091421 | 0.17239 |
| WLS | 0.20312 | 0.3665 | 0.2658 | 0.55066 | 0.44283 |
| LY6G5B | 0.0073753 | 0.10213 | 0.15646 | 0.12952 | 0.22932 |
| SLC22A2 | 0.1162 | 0.2498 | 0.205 | −0.066113 | 0.18033 |
| ELAVL4 | 0.25469 | 0.17251 | 0.21908 | 0.3676 | 0.35536 |
| NEBL | 0.31524 | 0.26515 | 0.23332 | −0.089818 | 0.15476 |
| GAS8 | 0.12859 | −0.14269 | −0.06206 | 0.2512 | −0.33445 |
| CCDC12 | −0.067653 | −0.15983 | −0.29611 | −0.17609 | 0.040609 |
| LGR5 | 0.021425 | 0.18208 | −0.025103 | −0.075922 | −0.083683 |
| SLC25A12 | −0.020633 | 0.32657 | 0.00050348 | 0.082029 | 0.20236 |
| LRRD1 | 0.24681 | 0.097053 | 0.060489 | 0.10626 | 0.18418 |
| CASQI | −0.090531 | −0.085573 | 0.074712 | 0.093628 | −0.07809 |
| LRRC59 | −0.13787 | 0.0071533 | 0.02398 | −0.11116 | −0.04998 |
| CTSH | 0.13222 | −0.0078678 | 0.12928 | 0.31475 | 0.28455 |
| RECQL | 0.23425 | 0.11933 | 0.11166 | 0.080167 | −0.036284 |
| PXDC1 | −0.052085 | 0.12178 | 0.25057 | 0.087873 | 0.24606 |
| POC5 | −0.081999 | 0.056866 | −0.0065636 | 0.14543 | −0.36172 |
| PIK3R2 | −0.17081 | −0.3371 | −0.34791 | −0.099049 | −0.089166 |
| PTPN21 | −0.028246 | −0.17114 | −0.06823 | 0.24978 | −0.11213 |
| ACTRT3 | −0.015406 | −0.10941 | 0.086538 | 0.30781 | −0.12896 |
| GRIA4 | 0.078821 | 0.19171 | 0.22024 | 0.23448 | 0.21592 |
| ADAM10 | −0.020655 | −0.25265 | 0.099292 | 0.32775 | −0.10773 |
| LUZP2 | −0.13267 | 0.045817 | 0.25745 | 0.24489 | 0.069205 |
| PUM2 | 0.024856 | 0.11123 | 0.092325 | 0.040503 | 0.26427 |
| HMGA2 | −0.059574 | 0.20532 | 0.19307 | −0.13111 | 0.38243 |
| PDP1 | 0.13669 | 0.0027095 | 0.49438 | 0.14555 | −0.17655 |
| SLC52A3 | −0.23397 | −0.34205 | 0.054301 | 0.16126 | −0.25282 |
| MCOLN3 | 0.1197 | 0.079341 | 0.2414 | −0.085626 | 0.02104 |
| CNTN1 | −0.13476 | −0.028032 | 0.23144 | 0.18212 | −0.021819 |
| VPS13B | −0.2378 | 0.10822 | −0.059972 | 0.048226 | −0.11626 |
| ADCYAP1R1 | 0.12688 | 0.17925 | 0.030888 | 0.26759 | −0.074517 |
| DNAAF1 | −0.14733 | −0.27945 | 0.21087 | 0.21347 | 0.25977 |
| LRRC1 | 0.074962 | 0.12959 | −0.17026 | 0.060224 | −0.11262 |
| TIGD2 | 0.19424 | 0.026696 | 0.08848 | 0.079189 | −0.19486 |
| CRBN | −0.071482 | −0.096299 | 0.11631 | −0.047103 | −0.056083 |
| EPS15 | 0.0045597 | 0.26291 | 0.098379 | 0.21946 | 0.30201 |
| MS4A6A | 0.55905 | 0.10168 | 0.30398 | 0.30627 | 0.33464 |

TABLE 8-continued

| | | | | | |
|---|---|---|---|---|---|
| TBC1D5 | 0.21994 | 0.25623 | 0.16941 | 0.02312 | 0.22202 |
| ACAD8 | −0.16414 | −0.17373 | 0.041736 | 0.088139 | −0.012956 |
| CARD14 | 0.11505 | −0.07 | 0.42325 | 0.24319 | 0.25064 |
| ZC3H14 | −0.30398 | 0.081085 | 0.024835 | 0.076898 | 0.34843 |
| DHX29 | −0.1703 | 0.096137 | −0.45546 | −0.074152 | 1.503 |
| PDE10A | 0.0089243 | 0.62648 | 0.24426 | 0.46027 | 0.036176 |
| DGKE | 0.016711 | −0.10677 | 0.29786 | 0.3174 | 0.2078 |
| FLG | 0.22053 | 0.18193 | 0.0053048 | 0.41276 | 0.21393 |
| PLCB4 | −0.259 | −0.091678 | 0.20733 | 0.15349 | −0.079491 |
| SYNC | 0.35182 | 0.24719 | 0.071026 | 0.29934 | 0.62945 |
| C6orf136 | −0.54805 | 0.18755 | 0.0747 | −0.12976 | −0.046949 |
| RIPK2 | −0.12615 | −0.16195 | −0.10288 | 0.044579 | 0.3812 |
| FBXO36 | 0.032477 | 0.043905 | 0.30918 | −0.25291 | 0.23997 |
| PAN2 | −0.20256 | 0.21333 | 0.18697 | −0.15178 | −0.39573 |
| ACPL2 | 0.049323 | −0.064258 | 0.12071 | 0.011874 | 0.22036 |
| TEAD2 | 0.15726 | 0.03185 | 0.01758 | −0.014904 | 0.20561 |
| RABGAP1L | 0.025991 | 0.047097 | 0.10841 | −0.044258 | −0.066754 |
| CA14 | −0.017924 | −0.17331 | −0.047115 | 0.018848 | 0.092885 |
| PPP2R1B | −0.008855 | 0.27826 | −0.17769 | 0.28771 | 0.0079668 |
| KANK4 | 0.129 | 0.13833 | 0.35476 | 0.35995 | 0.23477 |
| SPDEF | −0.65395 | −0.68409 | 0.22775 | 0.59734 | −0.17667 |
| PRELID2 | 0.17635 | 0.17343 | 0.2657 | 0.013359 | 0.22981 |
| METTL20 | 0.13115 | 0.43172 | −0.021712 | 0.075723 | 0.071586 |
| NDFIP1 | −0.26181 | −0.064148 | 0.32845 | −0.20393 | 0.17462 |
| FBXO4 | 0.14519 | 0.016144 | 0.30559 | 0.070931 | 0.24751 |
| TSPAN6 | 0.052265 | −0.27053 | 0.11152 | −0.007031 | 0.40894 |
| TMEM87B | 0.18742 | 0.0014893 | 0.36189 | 0.14211 | 0.034231 |
| SLC7A10 | 0.32521 | −0.04915 | 0.15684 | 0.43984 | −0.034209 |
| SLC8A1 | 0.31043 | 0.3231 | 0.0022339 | 0.20683 | −0.095834 |
| PYGO1 | 0.024627 | −0.20606 | 0.3001 | 0.065693 | 0.50035 |
| XRRA1 | 0.0069589 | 0.083622 | 0.040137 | 0.066092 | −0.0024986 |
| NCOA1 | 0.56229 | −0.055529 | 0.23175 | 0.42196 | −0.0030321 |
| SLC15A4 | 0.082137 | 0.053466 | 0.23093 | 0.1427 | 0.12827 |
| DNAH14 | 0.27322 | 0.32166 | 0.20616 | −0.14785 | −0.090517 |
| SLC6A19 | −0.094636 | 0.23258 | 0.014506 | 0.18216 | −0.048381 |
| AXDND1 | −0.11935 | −0.24422 | −0.033153 | 0.078975 | 0.15623 |
| MCOLN2 | −0.020887 | 0.21911 | 0.1735 | 0.044658 | −0.065455 |
| COMMD1 | −0.11246 | 0.34031 | −0.24497 | −0.049677 | 0.13403 |
| TBX19 | 0.20067 | 0.066597 | −0.060612 | 0.38236 | −0.077201 |
| TMEM87A | 0.31057 | 0.038538 | −0.0004963 | −0.31006 | 0.35863 |
| CAST | 0.17345 | −0.081266 | 0.36582 | 0.12521 | −0.0064021 |
| INTS12 | −0.079193 | 0.010648 | 0.32164 | 0.14603 | 0.68668 |
| RPS6KA2 | 0.1477 | 0.14065 | 0.42442 | −0.06107 | −0.025264 |
| CLEC1A | 0.26495 | 0.062027 | 0.14759 | 0.28786 | 0.44639 |
| CYP2J2 | 0.20688 | 0.26773 | 0.24352 | 0.13165 | 0.12466 |
| HSPA4 | −0.088869 | 0.0909 | 0.016909 | 0.0064698 | −0.10993 |
| C1orf51 | 0.081812 | −0.23926 | 0.21046 | 0.12224 | 0.22014 |
| TMTC1 | 0.011556 | −0.11814 | 0.14879 | 0.13338 | 0.1879 |
| TTC32 | 0.028209 | −0.48487 | 0.17601 | −0.22946 | 0.17076 |
| PTPRB | −0.099443 | −0.26534 | 0.29271 | 0.074692 | 0.063147 |
| TTC3 | 0.14062 | 0.31838 | 0.25624 | −0.20999 | 0.032329 |
| COMMD2 | −0.19711 | −0.022906 | 0.29122 | 0.29209 | −0.14385 |
| C2orf62 | −0.10388 | −0.24757 | 0.22478 | 0.31122 | 0.11208 |
| MTRF1 | 0.080671 | −0.050718 | −0.052494 | 0.045692 | 0.19788 |
| BICC1 | 0.33731 | 0.28589 | 0.39994 | 0.084352 | 0.32212 |
| STOM | −0.016944 | 0.20106 | 0.00072284 | 0.31346 | 0.28411 |
| DHRS7C | −0.16641 | −0.052412 | 0.22846 | 0.15593 | 0.21368 |
| SHF | 0.19804 | 0.1772 | 0.18065 | −0.1737 | 0.25808 |
| RNF121 | −0.018554 | −0.21615 | 0.13817 | 0.45893 | −0.044828 |
| SIX2 | 0.10149 | 0.049631 | 0.13847 | 0.29337 | −0.27847 |
| VPS33B | −0.043801 | 0.11328 | 0.038202 | −0.27728 | 0.031176 |
| TMEM241 | 0.16726 | −0.14027 | 0.28234 | −0.03202 | 0.11366 |
| RBM20 | 0.3721 | 0.11321 | 0.098349 | 0.15057 | 0.15518 |
| SAMHD1 | −0.13333 | −0.20372 | −0.31042 | −0.25206 | −0.22341 |
| IQGAP2 | −0.0095411 | 0.31902 | 0.084201 | 0.0494 | −0.17222 |
| PLCE1 | 0.16783 | 0.079319 | 0.022774 | 0.1386 | 0.12693 |
| HOGA1 | −0.46177 | −0.27652 | 0.016851 | 0.51081 | −0.013044 |
| RNF128 | 0.17733 | 0.14782 | 0.14684 | 0.43927 | 0.0083531 |
| SFXN2 | −0.044689 | 0.079211 | 0.01721 | 0.45208 | −0.02805 |
| ESR1 | −0.92751 | −0.33488 | 0.12137 | −0.11821 | 0.2139 |
| FYTTD1 | 0.11402 | −0.057746 | 0.12593 | −0.022288 | 0.02647 |
| ABCB5 | −0.078352 | 0.16561 | 0.1619 | 0.11182 | −0.012829 |
| RGS8 | 0.023926 | 0.38154 | 0.19028 | 0.12572 | 0.23543 |
| ZNF229 | −0.088519 | 0.1226 | −0.21107 | 0.10202 | −0.04914 |
| PCDH18 | −0.10743 | −0.15271 | 0.047704 | −0.011442 | −0.13742 |
| ETV1 | 0.057967 | 0.00020467 | 0.23772 | 0.3914 | −0.11266 |
| MRPL27 | −0.57921 | −0.39769 | −0.23484 | −0.18851 | −0.089994 |
| SUN3 | 0.02591 | 0.27733 | 0.31118 | 0.38577 | −0.25404 |
| KIF19 | −0.16848 | −0.23183 | −0.081947 | 0.15426 | 0.054311 |
| SAMD7 | 0.14931 | 0.31107 | 0.12349 | 0.25594 | 0.083039 |

TABLE 8-continued

| | | | | | |
|---|---|---|---|---|---|
| ANGEL1 | −0.25882 | −0.086547 | 0.083708 | 0.072437 | 0.23073 |
| ARSK | 0.081288 | 0.11907 | 0.35382 | 0.27684 | −0.070659 |
| TREM1 | 0.038894 | 0.17868 | 0.092727 | 0.23372 | 0.24942 |
| C1QC | −0.17103 | −0.088439 | −0.006826 | 0.014516 | 0.055482 |
| PHKG1 | 0.059772 | 0.16542 | 0.34606 | 0.16139 | 0.10464 |
| ALG8 | 0.28388 | −0.0025072 | −0.2166 | −0.043124 | −0.17947 |
| BMPR1B | −0.35325 | 0.28548 | 0.067155 | −0.01188 | 0.32315 |
| DNAJC7 | 0.043861 | 0.016906 | 0.095347 | −0.096839 | −0.0040848 |
| TBRG1 | −0.018571 | 0.028005 | 0.12483 | 0.15928 | 0.36242 |
| MINPP1 | −0.074352 | 0.18085 | 0.4448 | −0.0019622 | −0.31871 |

| HELA_T18.beta | RPE_T18.beta | DMSO14.beta | KBM7.beta | K562.beta | Jiyoye.beta |
|---|---|---|---|---|---|
| −0.011949 | 0.39445 | 0.13454 | 0.12333 | 0.031124 | 0.24711 |
| 0.047221 | −0.25512 | −0.58346 | −0.47421 | −0.41019 | −0.34178 |
| 0.11041 | 0.55851 | −0.1697 | −0.011855 | 0.15642 | 0.15595 |
| 0.041138 | 0.089877 | −0.32656 | 0.1066 | 0.30239 | 0.17146 |
| 0.33344 | 0.56475 | −0.18733 | 0.2166 | 0.24354 | 0.19838 |
| 0.28493 | 0.073424 | −0.41427 | −0.12634 | 0.26022 | 0.2508 |
| 0.13834 | 0.26324 | 0.14802 | 0.24493 | 0.34726 | 0.24637 |
| 0.25657 | 0.05366 | −0.020455 | 0.126 | 0.018399 | 0.16057 |
| 0.20364 | 0.18429 | 0.20068 | 0.16679 | 0.22044 | 0.10117 |
| 0.22453 | 0.20528 | 0.15802 | 0.078085 | 0.15902 | −0.012753 |
| 0.31185 | 0.55915 | −0.027456 | 0.16972 | 0.13479 | 0.12029 |
| 0.045429 | 0.23286 | 0.15529 | 0.080846 | 0.13486 | 0.02679 |
| 0.042624 | 0.088708 | 0.12273 | 0.19424 | 0.16343 | 0.12101 |
| 0.078477 | 0.0027162 | 0.045617 | 0.10846 | −0.022013 | 0.082919 |
| 0.095012 | 0.23503 | 0.10391 | 0.12471 | 0.25421 | 0.11207 |
| 0.12714 | 0.60101 | −0.1981 | 0.27746 | 0.22972 | 0.25076 |
| 0.12717 | 0.20684 | −0.068848 | 0.015087 | 0.23124 | 0.098974 |
| 0.16158 | 0.33575 | 0.16944 | 0.37182 | 0.16999 | 0.085352 |
| 0.14995 | 0.38049 | −0.25839 | 0.025702 | 0.30947 | 0.17425 |
| 0.12106 | 0.12759 | −0.096777 | 0.18819 | −0.0077838 | 0.02223 |
| 0.18694 | 0.0018059 | −0.011472 | 0.20368 | −0.0069569 | 0.18568 |
| −0.0029074 | −0.018502 | 0.15615 | 0.19087 | 0.21703 | −0.023216 |
| 0.11276 | −0.11765 | −0.17022 | −0.032466 | 0.11544 | −0.099806 |
| 0.099589 | 0.33019 | −0.26936 | 0.22156 | 0.34467 | 0.042291 |
| −0.01966 | 0.12544 | −0.069425 | 0.03303 | −0.017525 | 0.022512 |
| 0.03641 | 0.44554 | 0.17665 | 0.052423 | 0.18766 | 0.16327 |
| 0.05946 | −0.058455 | −0.10062 | 0.30894 | 0.1112 | 0.06913 |
| 0.21662 | 0.27602 | 0.23685 | 0.21964 | 0.16294 | 0.27794 |
| 0.077519 | 0.10829 | 0.18815 | 0.21426 | 0.037241 | 0.15338 |
| 0.20265 | 0.20955 | −0.18493 | 0.084245 | 0.24971 | −0.29516 |
| 0.25855 | 0.37111 | −0.048844 | 0.13617 | 0.0075685 | 0.26913 |
| 0.13291 | 0.20007 | −0.5265 | 0.19555 | −0.1679 | 0.0048835 |
| 0.090051 | 0.41419 | 0.31255 | 0.23593 | 0.33986 | 0.15477 |
| 0.060158 | −0.15199 | 0.18477 | 0.11013 | 0.092813 | 0.088168 |
| −0.15616 | 0.022731 | −0.0096634 | 0.39903 | 0.47216 | 0.087221 |
| 0.1586 | 0.34941 | 0.058591 | 0.26001 | 0.133 | 0.13607 |
| 0.076674 | 0.022149 | 0.20235 | 0.30547 | 0.19268 | 0.22574 |
| 0.056672 | −0.051132 | −0.22625 | 0.022184 | 0.2565 | 0.17917 |
| 0.12347 | 0.25573 | 0.033595 | 0.33797 | 0.33576 | 0.21865 |
| −0.16604 | 0.12612 | −0.10722 | 0.14337 | 0.23471 | 0.21739 |
| −0.14963 | −0.45167 | 0.27761 | 0.20866 | 0.073171 | 0.019044 |
| −0.086197 | 0.15555 | −0.11214 | 0.2498 | 0.44792 | 0.27094 |
| 0.14165 | 0.21072 | 0.13149 | −0.13686 | 0.11007 | −0.084942 |
| 0.038753 | 0.29622 | 0.17265 | 0.173 | 0.12578 | 0.24715 |
| 0.11798 | 0.2746 | 0.25868 | 0.1843 | 0.12828 | 0.15461 |
| 0.092981 | −0.071824 | −0.083463 | 0.081963 | 0.10469 | 0.18664 |
| 0.31848 | 0.41272 | 0.49344 | 0.15808 | 0.15842 | 0.2209 |
| 0.1885 | −0.19375 | 0.27331 | 0.42099 | 0.40001 | 0.26261 |
| 0.2667 | 0.28496 | 0.042387 | 0.23787 | 0.1509 | 0.0014402 |
| −0.22831 | −0.2924 | 0.14032 | −0.076115 | 0.19814 | −0.23025 |
| 0.33107 | 0.14844 | −0.089923 | 0.066379 | 0.10528 | 0.085841 |
| 0.25902 | 0.20988 | 0.18835 | 0.13862 | 0.10391 | 0.2725 |
| 0.12837 | 0.13395 | 0.11356 | −0.18958 | −0.0365 | 0.35341 |
| −0.022214 | 0.19903 | 0.15748 | 0.11717 | 0.047972 | 0.062954 |
| 0.32202 | 0.40471 | 0.16431 | 0.23037 | 0.33947 | 0.21903 |
| 0.13635 | 0.30423 | 0.021893 | 0.17606 | 0.14451 | −0.0154 |
| −0.11767 | −0.13878 | 0.12934 | 0.19742 | 0.28181 | 0.14394 |
| −0.052135 | −0.28333 | −0.11969 | 0.067585 | −0.30525 | 0.0028161 |
| −0.0027473 | 0.26344 | 0.2133 | 0.16894 | −0.079489 | 0.31478 |
| 0.48773 | −0.08821 | 0.27227 | 0.25865 | 0.56901 | 0.017686 |
| 0.15823 | −0.042612 | 0.0071116 | 0.1273 | 0.013534 | 0.31705 |
| 0.40302 | −0.21902 | 0.038493 | 0.21052 | 0.051407 | 0.16107 |
| 0.21284 | 0.25902 | 0.1764 | 0.25028 | 0.37817 | 0.23886 |
| 0.17459 | 0.057407 | 0.28545 | 0.16573 | 0.25617 | 0.075351 |
| −0.72238 | −0.03771 | −0.36793 | 0.1367 | 0.20271 | 0.39004 |
| 0.29486 | 0.095241 | −0.16819 | 0.30089 | 0.011888 | 0.041188 |
| 0.34379 | 0.30193 | −0.080022 | 0.032208 | 0.097808 | 0.010027 |

TABLE 8-continued

| | | | | | |
|---|---|---|---|---|---|
| −0.11544 | −0.076792 | −0.24814 | −0.039727 | 0.21745 | 0.22882 |
| 0.20955 | 0.13022 | −0.12289 | 0.18 | 0.20832 | 0.32005 |
| −0.094511 | 0.2035 | −0.055263 | 0.20482 | 0.14756 | 0.18095 |
| −0.20002 | −0.19267 | 0.05153 | 0.0030995 | −0.1777 | 0.058878 |
| 0.25628 | 0.58927 | −0.20471 | 0.46345 | 0.17908 | 0.30383 |
| 0.03334 | 0.2736 | −0.19997 | 0.3541 | 0.60428 | 0.22656 |
| 0.52776 | 0.46675 | 0.48875 | 0.22851 | −0.091208 | 0.14658 |
| 0.073692 | 0.84267 | 0.31645 | 0.29851 | 0.018255 | 0.32522 |
| −0.19635 | 0.12275 | −0.42085 | 0.093107 | 0.0041094 | −0.010594 |
| −0.0050775 | −0.071518 | 0.0077161 | 0.0061054 | 0.13264 | 0.16237 |
| 0.20616 | 0.48115 | 0.090157 | 0.24129 | 0.26639 | 0.047644 |
| 0.30487 | 0.31577 | 0.20079 | 0.23704 | 0.29806 | 0.16835 |
| 0.088431 | 0.33071 | 0.27999 | 0.2819 | 0.36613 | 0.31834 |
| 0.35647 | 0.62644 | −0.31214 | 0.12689 | 0.097429 | 0.14752 |
| 0.089758 | 0.23782 | 0.15886 | 0.31762 | 0.18042 | 0.26839 |
| 0.28427 | 0.29198 | −0.21525 | −0.027324 | −0.015434 | −0.033525 |
| 0.10568 | 0.8423 | −0.47367 | 0.41933 | 0.38131 | 0.25814 |
| 0.13221 | −0.15578 | −0.41863 | 0.12913 | 0.34034 | 0.17983 |
| 0.090099 | −0.15456 | 0.015416 | 0.19778 | 0.19713 | −0.18429 |
| 0.24204 | 0.12035 | −0.23669 | 0.24764 | 0.20678 | 0.25618 |
| 0.21699 | 0.18965 | 0.22243 | 0.4046 | 0.56071 | 0.023971 |
| 0.024531 | 0.2921 | 0.18743 | 0.090502 | 0.04732 | 0.13502 |
| 0.2726 | 0.2238 | −0.2211 | 0.26023 | 0.016599 | 0.24536 |
| 0.012109 | 0.13907 | −0.21726 | 0.20217 | −0.0025145 | 0.1914 |
| 0.050892 | −0.11896 | −0.23468 | 0.25142 | 0.44436 | 0.27646 |
| 0.084782 | 0.070077 | 0.066561 | 0.13145 | 0.22335 | 0.091063 |
| 0.0068529 | 0.2983 | −0.041887 | 0.07345 | −0.034927 | 0.13935 |
| 0.4518 | 0.29249 | −0.16607 | 0.12447 | −0.11204 | 0.022952 |
| 0.05686 | 0.15529 | −0.0023574 | 0.30801 | 0.064835 | 0.23111 |
| 0.056633 | 0.1298 | −0.12543 | 0.17107 | 0.15356 | 0.23828 |
| 0.21979 | 0.23145 | −0.2018 | 0.18308 | 0.017864 | 0.058616 |
| 0.32205 | 0.29038 | 0.0045918 | 0.22794 | 0.22353 | 0.12822 |
| −0.018188 | 0.017066 | −0.669 | 0.30135 | 0.51898 | 0.11032 |
| 0.28143 | 0.38372 | −0.042052 | 0.22207 | 0.5458 | 0.26154 |
| 0.27184 | −0.018642 | 0.016484 | −0.22442 | −0.27676 | −0.67094 |
| 0.12903 | 0.13686 | −0.037147 | 0.14067 | 0.23164 | 0.29563 |
| −0.035743 | 0.18032 | 0.065401 | 0.12227 | 0.13694 | 0.13322 |
| 0.15502 | 0.39266 | 0.27312 | 0.005615 | 0.049904 | −0.0048881 |
| 0.35493 | 0.73743 | −0.038183 | 0.29878 | 0.20696 | 0.1467 |
| 0.2191 | 0.2143 | −0.09793 | 0.31381 | 0.13213 | 0.23623 |
| 0.023245 | 0.12375 | −0.15744 | −0.028157 | 0.026316 | 0.040875 |
| 0.22145 | 0.38619 | 0.13794 | 0.21042 | 0.27088 | 0.2338 |
| 0.16007 | −0.4653 | −0.55666 | −0.44196 | −0.30601 | 0.022727 |
| −0.03359 | 0.002616 | −0.38377 | 0.14794 | 0.12765 | −0.098304 |
| 0.28016 | 0.30921 | −0.016343 | 0.23485 | −0.0026979 | 0.22466 |
| 0.64886 | 0.51174 | 0.090147 | 0.33146 | 0.29613 | 0.17807 |
| 0.10131 | 0.33916 | −0.24439 | 0.2197 | 0.30223 | 0.092704 |
| 0.30685 | 0.046858 | 0.039502 | 0.25587 | 0.34233 | 0.18157 |
| 0.29339 | 0.40837 | 0.12149 | −0.096711 | −0.010289 | −0.01598 |
| 0.11321 | −0.32874 | −0.33076 | 0.13314 | 0.31557 | 0.19854 |
| 0.34846 | 0.38022 | 0.18877 | 0.15974 | 0.031713 | 0.24209 |
| 0.33238 | 0.61579 | 0.32397 | 0.052328 | 0.20463 | 0.10143 |
| 0.053573 | 0.24981 | 0.22623 | 0.068938 | 0.021278 | 0.10495 |
| 0.30484 | 0.28666 | −0.54936 | 0.19116 | 0.12363 | 0.11833 |
| 0.0081519 | 0.068291 | −0.03408 | 0.08459 | 0.15545 | 0.27107 |
| −0.021575 | 0.35995 | 0.12794 | 0.12792 | 0.065927 | 0.10544 |
| 0.40486 | 0.3504 | −0.42805 | 0.10737 | 0.25379 | 0.035991 |
| 0.18018 | 0.44975 | −0.34094 | 0.26434 | 0.16755 | 0.24149 |
| 0.1415 | −0.041205 | 0.18968 | 0.19124 | 0.55088 | 0.36361 |
| 0.023312 | −0.54717 | −0.25999 | 0.25592 | 0.2927 | 0.049518 |
| 0.33864 | 0.13267 | 0.32288 | 0.19392 | 0.28378 | 0.088664 |
| −0.09549 | 0.18745 | −0.011091 | 0.29529 | −0.17153 | 0.50805 |
| 0.39517 | −0.28426 | −0.058113 | 0.15737 | 0.32269 | 0.28024 |
| 0.35837 | 0.31533 | −0.10761 | 0.23307 | 0.1781 | 0.16355 |
| 0.13833 | 0.032392 | 0.17026 | 0.024425 | 0.19598 | 0.079254 |
| −0.014089 | 0.029093 | 0.084641 | 0.1178 | −0.0077924 | 0.19235 |
| 0.19467 | 0.2386 | −0.069909 | 0.27642 | 0.074682 | 0.092246 |
| 0.26558 | 0.45934 | −0.10564 | 0.060329 | −0.20283 | 0.11516 |
| 0.2123 | −0.019154 | −0.0067196 | 0.10701 | 0.28511 | 0.19591 |
| 0.17126 | 0.023866 | 0.17495 | 0.26107 | 0.36001 | 0.26154 |
| 0.11099 | 0.24494 | 0.34416 | 0.25756 | −0.073485 | 0.12165 |
| 0.2987 | 0.2474 | −0.032485 | 0.16665 | 0.18688 | 0.11313 |
| −0.073033 | 0.32607 | −0.20045 | 0.2573 | 0.31024 | 0.13241 |
| 0.17982 | 0.29073 | −0.12697 | 0.32931 | 0.18396 | 0.2357 |
| 0.057556 | −0.12589 | 0.14264 | 0.31109 | 0.2264 | 0.074994 |
| 0.54134 | 0.39244 | 0.33659 | 0.27571 | 0.18047 | 0.26306 |
| 0.2688 | 0.2457 | −0.24584 | 0.021589 | 0.50339 | 0.1782 |
| 0.27303 | 0.45185 | 0.23846 | 0.17539 | 0.10253 | 0.15592 |
| −0.15334 | 0.32829 | −0.29637 | −0.073686 | −0.073865 | −0.031946 |
| 0.12061 | 0.27144 | −0.15032 | −0.27067 | 0.2872 | −0.64175 |

TABLE 8-continued

| | | | | | |
|---|---|---|---|---|---|
| 0.30553 | 0.41398 | −0.010021 | 0.08165 | 0.2904 | 0.3519 |
| 0.24798 | 0.16638 | 0.078342 | 0.21581 | 0.40019 | 0.2079 |
| −0.035782 | 0.30896 | 0.24633 | 0.15411 | 0.29437 | 0.045611 |
| −0.22295 | −0.061506 | −0.35293 | −0.28683 | 0.18307 | −0.26478 |
| 0.063679 | 0.068379 | 0.32442 | 0.3763 | 0.04561 | 0.17967 |
| 0.11677 | −0.017434 | 0.037421 | 0.1929 | 0.3038 | 0.11364 |
| 0.53022 | −0.0093741 | −0.26161 | 0.25292 | 0.28753 | 0.14871 |
| −0.23447 | −0.22178 | 0.087355 | 0.15927 | −0.22678 | 0.001896 |
| 0.163 | 0.39231 | −0.16947 | 0.34352 | 0.41955 | 0.24771 |
| 0.19569 | 0.30923 | 0.036211 | 0.15271 | 0.25087 | 0.096881 |
| 0.137 | 0.37302 | 0.24715 | 0.14755 | 0.10636 | 0.21499 |
| 0.092039 | 0.092547 | 0.13475 | 0.24907 | −0.0057623 | 0.1983 |
| 0.44208 | 0.035072 | −0.1352 | 0.28091 | 0.175 | 0.42554 |
| 0.042504 | 0.30367 | −0.43064 | −0.061846 | −0.64326 | −0.10046 |
| 0.58637 | 0.29813 | 0.0039383 | 0.10221 | −0.42211 | 0.15341 |
| 0.017323 | 0.17227 | −0.29868 | 0.25406 | −0.12486 | 0.094413 |
| 0.28544 | 0.46846 | −0.045204 | 0.14456 | −0.069434 | 0.1718 |
| 0.53528 | −0.07973 | 0.10609 | 0.092405 | 0.12779 | 0.28054 |
| 0.17996 | 0.10304 | 0.17467 | 0.075632 | 0.080738 | 0.29445 |
| 0.22661 | 0.40936 | 0.090128 | 0.19773 | 0.24835 | 0.21709 |
| −0.32209 | 0.31718 | 0.19007 | 0.1059 | 0.10459 | 0.16883 |
| 0.098014 | 0.43636 | −0.18923 | −0.14113 | 0.048201 | 0.061221 |
| 0.28027 | 0.51275 | 0.29567 | 0.43727 | 0.47061 | 0.067307 |
| 0.024027 | 0.24848 | −0.05223 | 0.14028 | 0.17667 | 0.12196 |
| 0.31517 | 0.23658 | 0.2845 | 0.31012 | 0.19318 | 0.0482 |
| 0.084977 | 0.18273 | −0.062732 | 0.22982 | 0.18372 | 0.26404 |
| 0.14433 | 0.11841 | 0.3176 | 0.082333 | 0.08599 | 0.18018 |
| −0.016785 | −0.11053 | −0.54944 | 0.37539 | −0.093928 | −0.0088064 |
| 0.31707 | 0.73105 | −0.56735 | 0.11223 | 0.071281 | 0.097951 |
| 0.1761 | 0.39622 | 0.077286 | 0.23119 | 0.29185 | 0.1609 |
| −0.04774 | 0.12092 | 0.56568 | 0.25204 | 0.33845 | 0.30644 |
| 0.46921 | 0.45623 | 0.26895 | 0.15175 | 0.40623 | 0.16581 |
| 0.51892 | 0.62105 | −0.1675 | 0.21746 | 0.14915 | 0.23036 |
| 0.08382 | 0.59384 | 0.05786 | −0.019238 | 0.269 | 0.17785 |
| 0.42432 | 0.54803 | −0.030133 | 0.11612 | 0.02784 | 0.14142 |
| 0.19368 | 0.41412 | 0.1963 | −0.199 | −0.14554 | 0.11541 |
| 0.31179 | 0.069658 | −0.0057461 | 0.18305 | 0.12981 | 0.0037264 |
| 0.45438 | 0.17055 | −0.16782 | 0.22692 | 0.51765 | 0.41785 |
| −0.040731 | −0.32876 | −0.21737 | −0.11153 | −0.05788 | −0.33434 |
| 0.18562 | 0.14074 | 0.25028 | 0.043559 | −0.094298 | 0.10227 |
| 0.15824 | 0.32275 | −0.24577 | −0.095522 | 0.1784 | 0.15609 |
| 0.45195 | 0.59896 | 0.012456 | 0.16108 | 0.11879 | 0.2272 |
| 0.076493 | −0.111 | −0.67334 | −0.083733 | −0.23414 | 0.24113 |
| 0.24755 | 0.27721 | −0.16413 | 0.32834 | −0.036639 | 0.33177 |
| 0.068031 | 0.13283 | 0.0073055 | −0.030887 | 0.37695 | 0.19713 |
| 0.31158 | −0.1808 | −0.0072829 | 0.12021 | 0.43374 | 0.054821 |
| 0.16601 | −0.29972 | −0.37644 | −0.068777 | 0.19219 | 0.18979 |
| 0.057924 | 0.21226 | −0.12438 | 0.032547 | 0.17533 | 0.038917 |
| 0.19906 | 0.1141 | −0.51558 | 0.26847 | 0.32938 | 0.027011 |
| 0.21228 | 0.37971 | −0.086278 | 0.22182 | 0.2163 | 0.021295 |
| 0.013067 | −0.14115 | 0.25892 | 0.15414 | −0.013295 | 0.18151 |
| 0.21752 | 0.092895 | −0.29521 | 0.15739 | −0.11891 | 0.05145 |
| 0.48606 | 0.39551 | 0.23832 | 0.17181 | 0.34107 | 0.0031355 |
| 0.33025 | 0.75184 | −0.015836 | 0.16354 | 0.29166 | 0.24932 |
| 0.13393 | 0.40185 | 0.19582 | 0.39339 | 0.3527 | 0.20039 |
| 0.19248 | 0.35518 | 0.0023149 | −0.0065096 | −0.47609 | −0.0064168 |
| 0.28697 | 0.12493 | 0.025235 | 0.32023 | 0.53755 | 0.2584 |
| 0.27184 | 0.24148 | −0.36805 | −0.11399 | −0.12003 | 0.085857 |
| 0.029645 | 0.2023 | −0.5489 | −0.21184 | 0.0039153 | 0.027712 |
| 0.26293 | −0.39395 | −0.019783 | −0.17556 | 0.033686 | −0.03756 |
| 0.10939 | 0.15526 | −0.33031 | 0.27925 | 0.36324 | 0.21575 |
| 0.053843 | 0.69195 | 0.014543 | 0.037288 | 0.3231 | 0.18236 |
| 0.12389 | 0.45126 | −0.10666 | 0.36821 | 0.13398 | 0.099721 |
| 0.017936 | 0.15344 | 0.17355 | 0.25019 | 0.085342 | 0.10135 |
| 0.094853 | −0.11046 | −0.026812 | 0.19643 | 0.32241 | 0.10424 |
| 0.50988 | 0.74094 | −0.0022333 | 0.044648 | 0.24253 | 0.22013 |
| 0.36749 | 0.45094 | −0.61537 | 0.31884 | 0.0028609 | 0.40165 |
| 0.17967 | 0.43605 | 0.19215 | 0.064957 | 0.17858 | 0.078051 |
| 0.48347 | 0.3993 | −0.42281 | 0.27906 | 0.037984 | 0.18998 |
| 0.0098262 | 0.16175 | −0.032022 | 0.17018 | 0.21355 | 0.16631 |
| −0.24061 | 0.013098 | −0.093627 | 0.27714 | 0.22319 | 0.14135 |
| 0.20511 | −0.041898 | −0.10955 | 0.32059 | 0.18616 | 0.34454 |
| −0.0239 | 0.064197 | −0.26571 | 0.18936 | 0.10103 | −0.020739 |
| 0.073131 | 0.028572 | 0.14037 | −0.069488 | 0.16237 | 0.20967 |
| 0.084874 | 0.11466 | −0.14367 | −0.30406 | −0.28873 | −0.17563 |
| −0.23405 | 0.29419 | −0.024309 | 0.010338 | −0.062061 | −0.074946 |
| 0.1698 | 0.41638 | 0.12276 | 0.23955 | 0.31208 | 0.25353 |
| 0.21065 | 0.27276 | −0.055177 | 0.27319 | 0.097702 | 0.15635 |
| 0.58458 | 0.61913 | 0.27569 | 0.21006 | −0.042727 | 0.060419 |
| 0.39339 | 0.1687 | −0.019202 | 0.1924 | 0.046692 | 0.006972 |

TABLE 8-continued

| | | | | | |
|---|---|---|---|---|---|
| 0.26044 | −0.35291 | −0.36559 | −0.40788 | −0.38659 | 0.1817 |
| 0.10528 | −0.1655 | 0.16247 | 0.18308 | 0.038385 | 0.0049192 |
| 0.52677 | 0.21134 | −0.28994 | 0.20463 | 0.39092 | 0.23179 |
| −0.023671 | 0.26691 | −0.008039 | 0.27348 | 0.24282 | 0.16694 |
| 0.033273 | −0.18147 | −0.25823 | −0.47641 | 0.023519 | −0.4291 |
| 0.096148 | −0.12369 | 0.013134 | 0.34273 | 0.37784 | 0.092789 |
| 0.1129 | −0.0069963 | 0.034206 | −0.053539 | −0.0063535 | 0.017703 |
| 0.050293 | 0.50846 | −0.039637 | 0.043327 | 0.36199 | 0.24576 |
| 0.29602 | 0.34387 | 0.18028 | 0.16569 | 0.24779 | 0.033519 |
| 0.32755 | 0.44179 | 0.19437 | 0.13743 | 0.13824 | 0.26205 |
| 0.37559 | 0.46509 | 0.0023543 | 0.20097 | 0.19016 | 0.27182 |
| −0.24557 | 0.43178 | −0.5618 | 0.10463 | 0.030776 | 0.15574 |
| 0.23247 | 0.23999 | −0.28099 | 0.32123 | 0.074719 | 0.028635 |
| 0.017914 | 0.47804 | −0.025248 | 0.2318 | 0.18082 | 0.23964 |
| 0.13499 | 0.30575 | 0.076976 | 0.066835 | −0.064538 | 0.21566 |
| 0.22059 | 0.33367 | 0.078414 | 0.10172 | 0.10345 | 0.046235 |
| 0.334 | 0.55565 | −0.042295 | 0.060709 | 0.20267 | 0.14989 |
| 0.13784 | 0.42941 | −0.23375 | 0.20001 | 0.18687 | 0.13629 |
| −0.209 | 0.067369 | 0.0921 | 0.18931 | −0.043065 | 0.044177 |
| 0.21599 | 0.13949 | 0.072332 | 0.31279 | 0.038848 | 0.14922 |
| 0.24632 | 0.48506 | 0.17441 | 0.31193 | 0.0409 | 0.09964 |
| 0.1524 | −0.1801 | −0.12021 | −0.050731 | 0.41004 | 0.04411 |
| 0.11387 | 0.33889 | 0.24021 | 0.083092 | 0.038679 | 0.1511 |
| 0.25763 | 0.35441 | −0.15422 | 0.18488 | 0.092987 | 0.11441 |
| 0.25503 | −0.049243 | −0.13817 | 0.45235 | 0.23928 | 0.13394 |
| 0.29131 | 0.35239 | −0.091345 | 0.046272 | 0.22381 | −0.047569 |
| 0.05424 | 0.26455 | 0.078982 | 0.24556 | 0.030716 | −0.013055 |
| 0.13367 | 0.45362 | 0.13645 | 0.20166 | 0.151 | 0.22299 |
| 0.45099 | 0.13927 | −0.24047 | −0.059267 | 0.036646 | −0.10895 |
| 0.011261 | −0.0636 | 0.45101 | 0.19889 | 0.018145 | 0.20427 |
| 0.33389 | 0.62872 | −0.17383 | 0.21162 | 0.023725 | 0.27027 |
| −0.05366 | 0.59204 | 0.20863 | 0.20576 | 0.22236 | 0.27832 |
| −0.029851 | 0.1846 | 0.072519 | −0.057719 | 0.14819 | 0.1528 |
| 0.045136 | 0.2953 | −0.0033213 | 0.063464 | 0.09446 | 0.11432 |
| 0.42652 | 0.73537 | 0.073982 | −0.004511 | −0.052559 | 0.11042 |
| −0.025105 | 0.39419 | 0.22946 | 0.13288 | 0.31679 | 0.12049 |
| 0.087341 | 0.22985 | −0.028544 | 0.20753 | 0.19675 | 0.13267 |
| 0.23568 | 0.22784 | −0.119 | 0.15881 | −0.022846 | −0.036039 |
| 0.31346 | 0.47438 | −0.25994 | −0.053827 | 0.33285 | 0.26788 |
| 0.40537 | 0.49549 | −0.11814 | 0.21999 | 0.092149 | 0.19816 |
| −0.21125 | −0.00018207 | −0.54196 | 0.015407 | 0.16354 | 0.14967 |
| 0.20875 | −0.024451 | −0.005013 | 0.23558 | 0.19029 | 0.15969 |
| 0.35781 | 0.28419 | −0.072389 | 0.18803 | 0.16435 | 0.070304 |
| 0.21126 | 0.24297 | −0.060018 | 0.25035 | 0.57392 | −0.019125 |
| −0.19119 | 0.23389 | −0.074107 | 0.29836 | 0.17694 | 0.16144 |
| 0.27561 | 0.049517 | 0.014405 | 0.35354 | 0.25636 | 0.20842 |
| 0.029854 | 0.1071 | −0.25286 | −0.11631 | −0.18507 | −0.13205 |
| −0.060907 | 0.45192 | −0.2445 | 0.045069 | −0.042464 | 0.17918 |
| −0.0019692 | −0.0042523 | −0.026582 | 0.16879 | 0.29023 | 0.029274 |
| −0.21521 | −0.15433 | −0.34839 | 0.11988 | 0.1094 | 0.16933 |
| −0.20009 | 0.077942 | 0.13775 | 0.2882 | 0.31555 | 0.19628 |
| 0.11647 | 0.029603 | 0.46118 | 0.36224 | 0.40418 | 0.02384 |
| 0.088808 | 0.22533 | −0.209 | 0.099308 | 0.027669 | 0.12794 |
| 0.32386 | 0.42596 | 0.20826 | 0.27434 | 0.3636 | 0.093295 |
| 0.1887 | 0.35806 | 0.28502 | 0.23085 | 0.10072 | 0.05052 |
| 0.30077 | 0.39065 | 0.12219 | 0.13395 | 0.14847 | 0.17812 |
| −0.11678 | −0.18957 | −0.29732 | −0.023744 | −0.1332 | 0.10741 |
| −0.075835 | 0.15168 | 0.18957 | 0.45956 | 0.59563 | 0.16281 |
| 0.010167 | 0.10248 | −0.49427 | 0.34946 | 0.34348 | 0.24162 |
| 0.10326 | −0.21057 | −0.33349 | −0.045731 | −0.090669 | −0.09459 |
| 0.060446 | 0.21431 | 0.11379 | −0.038708 | −0.15495 | 0.30099 |
| 0.015138 | −0.068808 | 0.16204 | −0.11624 | 0.43029 | 0.17519 |
| 0.057266 | 0.17208 | −0.25954 | 0.53447 | 0.38813 | 0.24808 |
| −0.036187 | −0.13549 | 0.47527 | 0.33855 | 0.48586 | 0.23116 |
| −0.075523 | −0.038374 | −0.08443 | 0.16033 | 0.44753 | 0.1537 |
| 0.065723 | 0.45361 | 0.16544 | 0.1191 | 0.074174 | −0.10399 |
| −0.094596 | 0.28542 | −0.25866 | 0.41366 | 0.21259 | 0.077309 |
| 0.15249 | 0.41475 | −0.0098342 | 0.136 | 0.22183 | 0.29426 |
| 0.017649 | 0.36594 | −0.25919 | 0.04497 | 0.021142 | 0.32361 |
| 0.024653 | 0.12005 | −0.23524 | −0.31375 | 0.13386 | −0.035989 |
| 0.24743 | 0.36322 | 0.038333 | 0.31845 | 0.39559 | 0.20708 |
| −0.018129 | −0.082906 | −0.063654 | 0.1146 | 0.077391 | 0.057249 |
| 0.20929 | 0.35645 | −0.036547 | −0.25574 | 0.15151 | 0.10276 |
| −0.2738 | 0.23156 | 0.26391 | −0.056211 | 0.19732 | −0.00044053 |
| −0.04454 | −0.095552 | 0.12427 | −0.038817 | −0.08411 | 0.017899 |
| 0.37997 | 0.097275 | −0.13598 | 0.20853 | 0.12104 | 0.22084 |
| 0.3714 | 0.4917 | −0.32259 | −0.15252 | −0.068506 | 0.0066961 |
| 0.062439 | 0.41406 | 0.057696 | 0.20863 | 0.43038 | 0.25783 |
| −0.046899 | 0.35684 | −0.48995 | 0.077849 | 0.41366 | 0.30809 |
| 0.18478 | 0.46485 | −0.50537 | 0.12456 | −0.27531 | 0.26307 |

TABLE 8-continued

| | | | | | |
|---|---|---|---|---|---|
| 0.43965 | 0.16087 | 0.097275 | −0.025233 | −0.29603 | 0.0021916 |
| −0.28598 | 0.31476 | 0.026845 | 0.02226 | −0.0058958 | −0.044596 |
| −0.014162 | 0.60501 | −0.10724 | 0.15485 | 0.09494 | 0.050949 |
| 0.2911 | 0.28884 | 0.10999 | 0.16597 | 0.3073 | 0.25161 |
| 0.20753 | 0.33256 | 0.00099747 | 0.17472 | 0.45717 | 0.104 |
| −0.095669 | 0.26583 | 0.26046 | 0.16208 | 0.41518 | 0.10874 |
| 0.25467 | 0.15984 | 0.050377 | 0.35772 | 0.025988 | 0.029716 |
| 0.13797 | −0.20802 | 0.042537 | 0.039981 | 0.22377 | 0.12427 |
| 0.047187 | 0.021521 | −0.12883 | 0.16766 | 0.25198 | 0.26201 |
| 0.076893 | −0.094444 | −0.52563 | −0.07779 | 0.52823 | 0.11366 |
| −0.078612 | 0.56872 | −0.23532 | 0.057807 | 0.30947 | 0.13025 |
| 0.0003996 | −0.11738 | −0.088742 | −0.42999 | 0.1796 | 0.043798 |
| 0.25347 | −0.058314 | 0.16136 | 0.062874 | 0.080327 | 0.07112 |
| 0.26673 | 0.1687 | 0.014596 | 0.075923 | 0.014374 | 0.089501 |
| 0.54219 | 0.30575 | 0.18501 | 0.39026 | −0.18432 | 0.16226 |
| −0.15577 | 0.2101 | 0.047609 | −0.034485 | −0.011397 | −0.021667 |
| 0.30844 | 0.48264 | −0.0011461 | 0.24827 | 0.18157 | 0.26048 |
| 0.051884 | −0.38116 | −0.33408 | 0.00099687 | −0.12873 | −0.26659 |
| 0.21477 | 0.88344 | −0.41791 | 0.015496 | 0.11432 | 0.12297 |
| 0.13693 | 0.2621 | 0.16403 | 0.21432 | 0.22835 | 0.15945 |
| −0.25976 | 0.13858 | 0.03572 | 0.26818 | 0.38953 | 0.28605 |
| 0.33231 | 0.35702 | 0.17736 | 0.19024 | 0.24258 | 0.18068 |
| −0.28396 | 0.061604 | −0.25719 | −0.23666 | −0.45139 | 0.045823 |
| 0.12635 | 0.39233 | 0.13062 | 0.28759 | 0.059129 | 0.095929 |
| 0.051109 | 0.2098 | −0.0098258 | 0.19053 | 0.34325 | 0.11676 |
| 0.55377 | 0.44744 | 0.32011 | −0.017891 | 0.096515 | 0.23755 |
| 0.28088 | 0.75273 | −0.09564 | 0.24269 | 0.23795 | 0.16015 |
| 0.027113 | 0.061029 | 0.19137 | 0.072221 | 0.16221 | −0.018211 |
| −0.21595 | 0.40451 | −0.25774 | −0.012206 | −0.22939 | 0.043494 |
| 0.61005 | 0.2958 | 0.16031 | 0.135 | 0.13617 | 0.038306 |
| 0.35721 | 0.042942 | 0.059614 | −0.18185 | −0.1832 | −0.016499 |
| 0.029064 | 0.34795 | 0.43016 | 0.38935 | 0.38182 | 0.22188 |
| 0.31574 | 0.093725 | −0.24611 | 0.40792 | 0.50303 | 0.21566 |
| 0.013928 | 0.27598 | 0.048897 | −0.17866 | 0.093581 | 0.087777 |
| −0.36157 | 0.10455 | −0.23776 | −0.012242 | −0.10096 | 0.14543 |
| −0.027747 | 0.23494 | −0.22676 | 0.11564 | 0.16078 | −0.031308 |
| −0.092261 | 0.037919 | −0.10386 | 0.063464 | −0.12803 | 0.057247 |
| 0.43873 | 1.0544 | −0.065194 | 0.12416 | 0.32875 | 0.16899 |
| 0.11482 | 0.14117 | 0.12304 | 0.14802 | 0.6518 | 0.22256 |
| −0.027038 | 0.25817 | 0.12847 | 0.1062 | 0.36054 | 0.20301 |
| −0.11059 | 0.19237 | 0.027653 | 0.066448 | 0.087214 | 0.1339 |
| 0.26299 | −0.16581 | 0.32292 | 0.23442 | 0.040247 | 0.31332 |
| 0.023067 | 0.38199 | −0.080889 | 0.072373 | 0.3514 | 0.16592 |
| 0.055217 | 0.35122 | 0.043914 | −0.14379 | 0.12913 | −0.11609 |
| 0.1959 | 0.14242 | 0.060423 | 0.29583 | 0.05937 | 0.11556 |
| 0.34056 | 0.069329 | −0.35076 | −0.44412 | −0.19999 | −0.2754 |
| −0.046725 | 0.16467 | −0.0083952 | 0.14645 | 0.48557 | 0.31821 |
| 0.087761 | 0.59587 | 0.054904 | 0.19446 | 0.31785 | 0.094625 |
| 0.22371 | 0.13367 | −0.18991 | −0.093554 | 0.029757 | −0.37697 |
| 0.20246 | 0.18919 | −0.19202 | 0.49189 | 0.41604 | 0.25173 |
| 0.47101 | 0.12682 | −0.061114 | 0.32115 | 0.30278 | 0.33896 |
| 0.13507 | 0.40832 | −0.19707 | 0.13842 | 0.2891 | 0.26493 |
| −0.003949 | 0.55732 | 0.38167 | 0.27879 | 0.32211 | 0.16133 |
| 0.11918 | 0.059982 | 0.64185 | 0.15476 | 0.35424 | 0.19647 |
| 0.2931 | 0.098653 | 0.10296 | 0.19659 | 0.017382 | 0.22621 |
| 0.025194 | 0.35481 | −0.094885 | 0.24901 | 0.28013 | 0.11042 |
| 0.45797 | 0.25075 | −0.36046 | 0.27476 | 0.39764 | 0.16451 |
| −0.0062341 | 0.28854 | −0.16452 | 0.31565 | 0.16041 | 0.12428 |
| 0.44455 | 0.13646 | 0.073218 | 0.17082 | 0.36051 | −0.064507 |
| 0.25617 | 0.077437 | −0.0053971 | 0.3279 | 0.4793 | 0.13777 |
| 0.36905 | 0.51134 | 0.00046177 | 0.097706 | 0.047733 | −0.014391 |
| −0.24189 | 0.062095 | 0.16568 | 0.1556 | 0.31397 | 0.014646 |
| 0.34664 | 0.73984 | −0.05925 | 0.21433 | 0.35771 | 0.28867 |
| 0.02009 | 0.59857 | 0.19358 | 0.057395 | 0.11823 | 0.32045 |
| 0.45572 | 0.56694 | 0.34047 | 0.24236 | −0.010127 | 0.049664 |
| 0.21546 | 0.45252 | 0.046323 | −0.041848 | −0.055515 | 0.023058 |
| 0.17872 | −0.075701 | 0.017296 | −0.063199 | −0.16962 | 0.19576 |
| 0.17536 | 0.19855 | −0.089301 | 0.20361 | 0.087541 | 0.21014 |
| 0.054357 | 0.37766 | 0.076884 | 0.1518 | 0.18754 | −0.22932 |
| 0.18701 | 0.26252 | 0.011513 | 0.19778 | 0.47676 | 0.50546 |
| 0.41269 | 0.25223 | −0.040628 | 0.20647 | 0.16136 | 0.17867 |
| 0.51659 | 0.13164 | 0.078671 | 0.063796 | −0.31685 | 0.030916 |
| 0.26886 | 0.23692 | −0.18164 | 0.26764 | 0.26574 | 0.46905 |
| 0.21962 | 0.097041 | −0.03881 | 0.12233 | 0.10895 | 0.20638 |
| −0.17704 | 0.29264 | −0.025292 | 0.16101 | −0.036399 | 0.151 |
| 0.14785 | −0.085249 | 0.027937 | 0.090782 | 0.27699 | 0.16666 |
| 0.32053 | 0.36081 | −0.090233 | 0.11097 | 0.12678 | 0.016346 |
| 0.074905 | −0.20064 | 0.094204 | 0.36534 | 0.41637 | 0.30246 |
| 0.044633 | −0.13999 | 0.14161 | 0.3216 | 0.29026 | 0.1389 |
| −0.03448 | 0.13366 | 0.10084 | 0.34442 | 0.21217 | 0.1278 |

TABLE 8-continued

| | | | | | |
|---|---|---|---|---|---|
| 0.15338 | 0.016911 | −0.035566 | 0.38682 | 0.14117 | 0.29717 |
| 0.14611 | −0.21811 | −0.13553 | 0.22967 | −0.2083 | 0.31812 |
| 0.10495 | 0.098415 | 0.046907 | 0.22229 | 0.31436 | −0.031826 |
| 0.042928 | 0.70277 | 0.29366 | 0.24349 | 0.42881 | 0.17939 |
| 0.19147 | 0.33065 | −0.026507 | 0.17381 | 0.17555 | 0.20557 |
| −0.073692 | −0.14159 | −0.31789 | 0.070296 | 0.077032 | 0.17829 |
| 0.17934 | 0.080518 | −0.13779 | 0.2269 | 0.3813 | 0.20846 |
| −0.039622 | 0.67422 | −0.10361 | 0.083408 | 0.34426 | 0.22056 |
| 0.54273 | 0.38553 | 0.027114 | 0.31107 | 0.57859 | 0.18782 |
| 0.21138 | −0.16013 | 0.28581 | 0.23811 | 0.32858 | 0.12338 |
| 0.51381 | 0.34648 | 0.088083 | 0.062465 | 0.10241 | 0.29104 |
| 0.054736 | 0.21635 | 0.19313 | 0.014276 | 0.37241 | 0.18065 |
| 0.62466 | 0.87946 | 0.43417 | 0.23651 | 0.013071 | 0.27898 |
| 0.084109 | 0.60418 | −0.17155 | 0.42165 | 0.25103 | 0.26248 |
| 0.25667 | 0.24675 | −0.041575 | 0.40486 | 0.36346 | 0.33831 |
| 0.0077571 | 0.099511 | −0.01772 | −0.22029 | 0.087802 | −0.11604 |
| 0.11794 | 0.31753 | 0.22295 | −0.081449 | 0.35067 | 0.37919 |
| 0.16518 | 0.090178 | −0.10078 | 0.14767 | 0.10387 | 0.19364 |
| 0.17501 | 0.24741 | 0.36865 | 0.21505 | 0.32826 | 0.21265 |
| −0.079626 | 0.086935 | 0.018977 | 0.32048 | 0.18336 | −0.065725 |
| −0.071572 | 0.037965 | −0.051008 | −0.04333 | −0.0178 | −0.049753 |
| 0.21517 | 0.33506 | 0.35415 | 0.28546 | 0.24566 | 0.083546 |
| 0.1651 | 0.28287 | −0.18737 | 0.16694 | 0.28401 | 0.11326 |
| −0.15899 | 0.099044 | 0.054196 | 0.34622 | 0.21586 | 0.36486 |
| 0.44823 | 0.11674 | 0.51544 | 0.1534 | 0.06575 | 0.3295 |
| 0.21001 | 0.33964 | −0.1744 | 0.11191 | 0.036949 | 0.097239 |
| 0.18121 | 0.30597 | −0.18921 | 0.11278 | 0.10983 | 0.48073 |
| 0.40021 | 0.5634 | 0.065251 | 0.22349 | 0.22999 | 0.13646 |
| 0.19468 | 0.69253 | 0.33156 | 0.2304 | 0.21734 | 0.25603 |
| −0.18909 | 0.10183 | −0.32928 | 0.30289 | 0.35235 | 0.33909 |
| −0.00083136 | 0.33553 | −0.026289 | 0.34738 | 0.2182 | 0.000134 |
| −0.16262 | 0.045291 | −0.20294 | −0.10493 | 0.23645 | −0.014649 |
| 0.40776 | 0.36446 | 0.17788 | 0.13896 | −0.05962 | −0.33955 |
| 0.32401 | 0.60738 | −0.055718 | 0.12782 | −0.19894 | −0.050124 |
| 0.26731 | 0.20643 | 0.10615 | 0.066259 | −0.0072281 | 0.030869 |
| 0.54479 | −0.11188 | −0.17348 | 0.12763 | 0.28893 | −0.038629 |
| 0.33298 | 0.22407 | 0.17252 | 0.085708 | −0.031922 | −0.055616 |
| −0.088303 | 0.25338 | 0.10778 | 0.21151 | 0.024613 | 0.15742 |
| −0.0096933 | −0.23473 | 0.36345 | −0.10032 | −0.057105 | 0.22561 |
| 0.33161 | 0.58765 | −0.31632 | 0.28709 | 0.19745 | 0.39001 |
| 0.26294 | 0.84164 | 0.3022 | 0.13224 | 0.35368 | 0.1559 |
| 0.46703 | 0.26759 | −0.088055 | 0.33505 | 0.39338 | 0.21113 |
| 0.38004 | 0.52533 | 0.073363 | 0.2327 | 0.20522 | 0.075632 |
| 0.082998 | 0.02599 | −0.12159 | 0.24301 | 0.4257 | 0.13292 |
| 0.058758 | 0.62096 | 0.11965 | 0.17423 | 0.33635 | 0.21375 |
| 0.072744 | −0.001628 | 0.14915 | 0.37865 | 0.48011 | 0.33885 |
| −0.26641 | 0.15912 | −0.26599 | −0.088281 | −0.45165 | 0.048274 |
| 0.42624 | 0.37088 | −0.080517 | 0.39675 | 0.28294 | 0.19737 |
| 0.3693 | 0.37087 | 0.052716 | −0.053331 | 0.34358 | 0.16235 |
| −0.17681 | 0.37026 | 0.4871 | 0.020135 | −0.18308 | 0.019313 |
| −0.048124 | 0.39509 | 0.22311 | 0.23803 | 0.16435 | 0.14849 |
| −0.11542 | 0.11993 | 0.027604 | 0.19905 | 0.50004 | 0.32363 |
| 0.65636 | 0.12499 | −0.36493 | 0.12235 | 0.097972 | 0.099239 |
| 0.067005 | 0.35986 | 0.075992 | −0.0088313 | 0.55458 | −0.043099 |
| 0.093112 | 0.10238 | −0.086984 | 0.17435 | 0.30058 | −0.011122 |
| −0.49885 | −0.28048 | 0.53847 | 0.20483 | 0.244 | 0.011552 |
| −0.12122 | 0.0087289 | 0.21616 | −0.22195 | 0.3209 | −0.12792 |
| −0.20454 | −0.0022684 | −0.10675 | 0.33395 | 0.25208 | 0.26421 |
| 0.31303 | 0.069408 | 0.22074 | 0.21373 | 0.29856 | 0.15312 |
| 0.48727 | 0.52712 | 0.46507 | 0.35872 | 0.30017 | 0.25826 |
| 0.13227 | 0.028281 | 0.40765 | 0.25714 | 0.13992 | 0.3415 |
| 0.12583 | 0.088001 | 0.125 | 0.42304 | −0.33932 | 0.34458 |
| 0.17803 | 0.98985 | −0.10783 | 0.023986 | −0.27197 | 0.15052 |
| 0.072139 | 0.37192 | −0.063142 | 0.095577 | 0.37776 | 0.31908 |
| 0.43568 | 0.4035 | 0.055721 | 0.14539 | 0.086211 | 0.071659 |
| −0.15551 | 0.21124 | −0.33204 | −0.3858 | −0.44893 | 0.0027806 |
| 0.41058 | 0.66502 | 0.38043 | −0.24194 | 0.032294 | −0.059877 |
| 0.096244 | −0.27233 | −0.30858 | 0.12201 | 0.06764 | 0.19921 |
| −0.062789 | −0.15684 | 0.082621 | 0.17707 | −0.064042 | 0.10822 |
| −0.084476 | 0.21132 | 0.15064 | −0.092392 | −0.34638 | −0.10471 |
| −0.1563 | 0.53413 | 0.022296 | 0.20374 | 0.19999 | 0.020812 |
| 0.07865 | 0.13627 | −0.1472 | 0.10662 | 0.18487 | −0.072916 |
| 0.20666 | 0.25697 | −0.091706 | 0.27249 | 0.32271 | 0.24607 |
| −0.089575 | −0.0087483 | −0.34159 | 0.38126 | 0.2686 | 0.23979 |
| 0.36081 | 0.67759 | 0.41184 | 0.33088 | 0.19069 | 0.2916 |
| 0.35436 | 0.38465 | −0.16669 | 0.32168 | 0.28153 | 0.2825 |
| 0.13363 | 0.032352 | −0.059887 | 0.02618 | 0.3325 | 0.13163 |
| 0.10641 | −0.030176 | 0.1117 | 0.18804 | −0.072759 | 0.24058 |
| 0.30257 | −0.076072 | −0.0041448 | 0.17488 | 0.14075 | 0.11121 |
| 0.11145 | 0.1783 | −0.36359 | 0.19103 | 0.15082 | 0.025246 |

TABLE 8-continued

| | | | | | |
|---|---|---|---|---|---|
| −0.23918 | 0.05933 | −0.074743 | 0.23228 | 0.29443 | −0.18376 |
| 0.076469 | −0.0053022 | −0.2955 | 0.087587 | 0.32097 | 0.15173 |
| 0.24803 | 0.47504 | 0.061911 | 0.0059042 | 0.088863 | −0.071107 |
| −0.041753 | 0.081325 | −0.18417 | −0.0011084 | 0.24657 | 0.14375 |
| 0.41714 | 0.51581 | 0.0013253 | 0.13622 | −0.14457 | 0.048649 |
| 0.10455 | 0.35768 | −0.023651 | 0.32294 | 0.11207 | 0.048705 |
| −0.23498 | −0.0077176 | −0.042433 | 0.084527 | −0.074671 | 0.10706 |
| 0.08439 | 0.14165 | 0.49177 | −0.051237 | −0.012637 | 0.08763 |
| 0.27537 | 0.13558 | −0.14664 | 0.35165 | 0.33312 | 0.12784 |
| −0.02377 | −0.064551 | 0.27204 | 0.38633 | 0.10508 | 0.20871 |
| 0.57948 | 0.22376 | 0.067271 | 0.18536 | −0.010303 | 0.077483 |
| −0.12787 | −0.16729 | −0.18694 | 0.015039 | 0.18451 | 0.16509 |
| 0.33233 | 0.50565 | 0.024454 | 0.093813 | 0.022642 | 0.10012 |
| 0.076426 | 0.41352 | −0.32239 | 0.058325 | 0.035203 | 0.14809 |
| 0.11038 | 0.53275 | −0.15354 | 0.23364 | 0.11473 | 0.06762 |
| 0.19651 | 0.358 | 0.051303 | −0.00675 | 0.083128 | 0.16963 |
| 0.23243 | 0.66075 | 0.15545 | 0.091419 | −0.0080215 | 0.35484 |
| −0.092031 | −0.076506 | −0.095417 | 0.094643 | −0.071728 | −0.07501 |
| 0.22145 | 0.33648 | 0.02003 | 0.16513 | 0.37513 | 0.24853 |
| −0.20165 | −0.25808 | −0.40164 | −0.079031 | −0.036726 | 0.1403 |
| 0.15864 | 0.52902 | −0.10748 | 0.063615 | 0.36115 | 0.10878 |
| 0.27485 | −0.28682 | 0.098494 | 0.050856 | −0.064342 | −0.052076 |
| 0.3517 | 0.48645 | −0.21142 | 0.11282 | 0.3101 | 0.15209 |
| 0.34529 | 0.4575 | 0.082027 | 0.13014 | 0.07422 | 0.052067 |
| 0.33415 | 0.46575 | −0.042461 | 0.092922 | 0.33878 | 0.4381 |
| 0.49313 | 0.76083 | −0.2957 | 0.18699 | 0.36676 | 0.10264 |
| −0.048105 | 0.12656 | 0.31379 | 0.058526 | 0.10635 | 0.1549 |
| 0.13255 | 0.29434 | −0.20914 | 0.19674 | 0.50428 | 0.21191 |
| 0.4057 | 0.61283 | 0.29411 | 0.31545 | 0.2227 | 0.16393 |
| 0.11411 | 0.23002 | 0.068164 | 0.097725 | 0.033418 | −0.34543 |
| 0.32235 | 0.38269 | −0.31661 | 0.39457 | 0.58393 | 0.36389 |
| 0.25898 | 0.021145 | 0.37069 | −0.057537 | −0.0004742 | 0.053991 |
| 0.79236 | 0.22814 | −0.36523 | 0.11914 | 0.26009 | 0.17938 |
| −0.0024814 | 0.0046601 | 0.11995 | 0.028952 | −0.23446 | 0.11157 |
| 0.18786 | 0.3455 | −0.18046 | 0.49923 | 0.23268 | 0.46397 |
| 0.053302 | −0.24777 | −0.33927 | 0.20597 | 0.38096 | 0.1972 |
| −0.1872 | 0.22637 | −0.011656 | 0.39714 | 0.25238 | 0.30178 |
| −0.043668 | 0.10964 | 0.11212 | 0.079395 | 0.086478 | 0.18629 |
| 0.096561 | 0.46244 | 0.10432 | 0.009312 | 0.21613 | 0.21505 |
| −0.026211 | −0.014763 | 0.12024 | 0.20732 | 0.086205 | 0.074012 |
| 0.1428 | 0.32355 | 0.034229 | 0.30686 | 0.14014 | −0.028823 |
| 0.41066 | 0.24933 | −0.096379 | 0.2097 | 0.4046 | 0.088971 |
| 0.33157 | 0.4149 | 0.03932 | 0.16236 | 0.39081 | 0.23355 |
| 0.28228 | −0.14647 | −0.074593 | 0.17644 | −0.019011 | 0.14624 |
| 0.062438 | 0.1771 | −0.16403 | −0.0079845 | −0.16762 | 0.033853 |
| 0.27248 | 0.98355 | 0.048817 | 0.18456 | −0.21238 | −0.0026819 |
| 0.18976 | 0.11576 | −0.091031 | 0.44486 | 0.6374 | 0.21345 |
| −0.27367 | 0.13069 | −0.064439 | −0.020175 | 0.017893 | 0.082167 |
| −0.031319 | 0.2715 | 0.057398 | 0.043311 | −0.082649 | −0.12085 |
| −0.056166 | −0.083534 | −0.39164 | −0.41958 | −0.22283 | −0.52091 |
| 0.3253 | 0.27127 | −0.073959 | 0.18675 | −0.064852 | 0.21416 |
| 0.22868 | 0.75355 | −0.085221 | 0.071332 | 0.231 | 0.11621 |
| 0.36563 | 0.38344 | 0.4176 | 0.078622 | 0.1701 | 0.11111 |
| −0.0067859 | 0.25814 | 0.010189 | −0.0050914 | −0.095786 | 0.11204 |
| 0.061189 | 0.37867 | −0.13437 | −0.22846 | −0.39668 | −0.27069 |
| 0.7427 | 0.65395 | 0.30259 | 0.013615 | 0.033333 | −0.053719 |
| 0.073774 | 0.3066 | 0.077834 | −0.01707 | −0.041362 | 0.10014 |
| 0.25369 | 0.30397 | −0.062124 | 0.12046 | −0.12019 | −0.029868 |
| 0.08864 | 0.22632 | −0.012735 | 0.18389 | −0.022644 | 0.061658 |
| 0.11487 | 0.38201 | −0.011811 | 0.13744 | 0.53467 | 0.16762 |
| 0.37442 | 0.4028 | −0.13554 | 0.29553 | 0.17581 | 0.235 |
| 0.017517 | 0.058028 | −0.28582 | −0.1835 | −0.20534 | 0.029126 |
| 0.34723 | 0.055633 | −0.4288 | −0.23748 | −0.36478 | −0.41816 |
| 0.24008 | −0.27238 | 0.31252 | 0.15039 | −0.10889 | 0.049038 |
| −0.030231 | 0.12657 | 0.40881 | 0.044452 | 0.047254 | −0.089119 |
| 0.28295 | 0.61586 | −0.11351 | 0.3094 | 0.22465 | 0.24734 |
| −0.13561 | 0.22116 | 0.2411 | −0.071823 | −0.24426 | −0.024087 |
| 0.44865 | −0.26322 | −0.17863 | −0.1092 | −0.18459 | −0.059702 |
| 0.03508 | 0.17018 | −0.1294 | −0.11662 | 0.27758 | 0.13311 |
| 0.2059 | −0.02768 | −0.011392 | 0.25556 | 0.3253 | 0.13612 |
| 0.20075 | −0.034644 | −0.0035187 | 0.54738 | 0.39391 | 0.33304 |
| 0.11205 | −0.21434 | −0.15227 | 0.13884 | 0.11865 | 0.0055283 |
| −0.17625 | −0.38581 | −0.08846 | 0.17485 | −0.12075 | 0.065219 |
| 0.22141 | 0.19425 | 0.055453 | 0.1317 | 0.34855 | −0.025543 |
| −0.19345 | 0.20312 | 0.29775 | 0.12846 | 0.43185 | −0.11344 |
| 0.40302 | 0.56495 | 0.33294 | 0.28708 | 0.25145 | 0.11404 |
| 0.372 | 0.77532 | 0.22824 | 0.058003 | 0.11962 | 0.013211 |
| −0.079659 | 0.22282 | −0.12476 | 0.28798 | 0.44824 | 0.22062 |
| 0.024643 | 0.11046 | 0.13495 | −0.083144 | 0.22247 | −0.041268 |
| 0.15136 | −0.0079469 | −0.047728 | 0.16459 | 0.22913 | 0.2181 |

TABLE 8-continued

| | | | | | |
|---|---|---|---|---|---|
| 0.3184 | 0.2149 | −0.004224 | 0.3089 | 0.48531 | 0.3283 |
| 0.23895 | 0.19101 | −0.020534 | −0.097363 | 0.054302 | −0.093053 |
| 0.031914 | 0.27791 | 0.0062082 | 0.35281 | 0.12012 | 0.03569 |
| 0.61239 | 0.90994 | −0.13061 | 0.2745 | 0.039959 | 0.035387 |
| 0.22946 | 0.16347 | −0.14455 | 0.093717 | 0.39507 | 0.36999 |
| 0.15703 | 0.30262 | 0.0034915 | 0.16358 | 0.061361 | 0.27077 |
| 0.27962 | 0.03638 | −0.24826 | 0.36178 | 0.3205 | 0.18118 |
| 0.09729 | 0.33339 | −0.031105 | 0.097341 | 0.12314 | 0.098714 |
| −0.17347 | 0.19674 | 0.15925 | 0.3517 | 0.46336 | 0.18166 |
| −0.11137 | −0.1845 | −0.055158 | −0.020608 | 0.079696 | 0.011935 |
| 0.35852 | −0.08232 | −0.049617 | 0.13117 | 0.1027 | 0.14507 |
| 0.48516 | 0.68722 | −0.075989 | 0.22639 | 0.33915 | 0.089964 |
| 0.13782 | 0.43073 | −0.080257 | −0.21392 | −0.13993 | 0.086172 |
| 0.42111 | 0.26505 | −0.081551 | 0.1715 | 0.12883 | 0.066404 |
| 0.32995 | 0.044848 | −0.14353 | −0.077498 | −0.25573 | 0.02562 |
| 0.19181 | 0.063732 | −0.18734 | 0.044856 | 0.32703 | −0.11245 |
| 0.31842 | −0.4006 | −0.24591 | −0.21236 | −0.18584 | 0.1138 |
| 0.21286 | 0.51931 | 0.19347 | 0.16503 | 0.11927 | 0.24308 |
| 0.17654 | 0.39729 | 0.15414 | 0.085579 | −0.17666 | −0.13076 |
| 0.18959 | 0.38203 | −0.0059404 | −0.0571 | −0.24997 | −0.13103 |
| −0.020487 | 0.033805 | 0.013032 | 0.18837 | 0.088124 | 0.14271 |
| 0.27454 | −0.07109 | 0.068417 | −0.06036 | 0.0090262 | −0.073812 |
| −0.12525 | −0.26696 | 0.11154 | −0.045405 | −0.329 | −0.40126 |
| 0.17681 | 0.0183 | 0.016486 | 0.21694 | 0.17016 | 0.23557 |
| 0.29575 | 0.26969 | −0.14173 | 0.32505 | 0.34583 | 0.27736 |
| 0.30588 | −0.36228 | 0.045266 | −0.024008 | −0.099096 | 0.20056 |
| 0.093628 | 0.49926 | 0.027143 | 0.26334 | −0.088651 | 0.13385 |
| 0.32288 | −0.047006 | −0.11956 | −0.081831 | −0.015211 | −0.17359 |
| −0.068632 | 0.1886 | −0.13525 | −0.29511 | 0.092543 | −0.038386 |
| 0.28342 | 0.30901 | 0.028285 | 0.012645 | 0.10728 | 0.039337 |
| 0.18063 | 0.37012 | −0.042485 | 0.28265 | 0.16897 | 0.11176 |
| 0.40614 | 0.55969 | −0.074499 | 0.020395 | −0.050244 | 0.026386 |
| 0.072284 | 0.18147 | 0.070586 | 0.053193 | −0.16559 | −0.20789 |
| −0.18396 | −0.2193 | −0.15051 | 0.27556 | 0.30859 | 0.31915 |
| −0.058028 | −0.23168 | 0.34287 | 0.17176 | −0.085518 | −0.083588 |
| 0.15071 | 0.55968 | −0.054853 | 0.28338 | 0.45185 | 0.1024 |
| 0.45978 | 0.35565 | −0.15516 | 0.12942 | 0.15807 | 0.17521 |
| −0.18803 | 0.28368 | 0.081906 | 0.23236 | 0.31552 | 0.22119 |
| 0.10421 | 0.32091 | 0.089018 | 0.11613 | −0.19997 | −0.079772 |
| 0.25621 | 0.25854 | 0.097708 | 0.12856 | 0.014539 | 0.049764 |
| −0.1535 | −0.00081109 | 0.0034649 | 0.16421 | 0.335 | 0.0018668 |
| −0.053891 | 0.12478 | 0.15804 | 0.22698 | 0.29129 | 0.12495 |
| 0.41067 | 0.38177 | 0.16981 | −0.12193 | −0.34527 | −0.015767 |
| 0.33109 | 0.78823 | 0.014566 | 0.19916 | 0.09713 | 0.26438 |
| 0.6656 | 0.63987 | −0.056857 | 0.45676 | 0.16476 | 0.14928 |
| 0.19667 | 0.20295 | 0.15417 | 0.24118 | 0.19375 | 0.14664 |
| −0.095174 | 0.042925 | 0.078537 | 0.22308 | −0.037741 | 0.12866 |
| 0.43575 | 0.37514 | 0.052673 | 0.12953 | 0.095194 | 0.16348 |
| 0.40749 | 0.22915 | 0.029395 | 0.1722 | 0.098782 | −0.0042293 |
| 0.17376 | −0.26648 | 0.027341 | 0.077807 | 0.15395 | 0.26891 |
| 0.023736 | 0.28125 | 0.31053 | 0.084986 | 0.061414 | 0.1154 |
| 0.43825 | 0.43759 | −0.056995 | 0.26431 | 0.26955 | 0.09418 |
| 0.4376 | 0.19776 | −0.11973 | 0.024984 | 0.30524 | 0.10428 |
| 0.23255 | 0.22593 | −0.30094 | −0.22945 | 0.34138 | −0.043565 |
| 0.44955 | 0.7411 | −0.069676 | 0.172 | 0.12283 | 0.020113 |
| 0.40628 | 0.67585 | −0.012234 | 0.22682 | 0.22412 | 0.099211 |
| −0.14397 | 0.12346 | −0.10113 | 0.14743 | 0.14749 | 0.15325 |
| 0.084318 | 0.10545 | 0.03646 | 0.021388 | 0.46092 | 0.32141 |
| 0.077621 | 0.40488 | −0.33262 | 0.087472 | −0.28051 | 0.062294 |
| 0.30178 | 0.43077 | −0.24176 | 0.068512 | 0.023013 | 0.087711 |
| 0.22061 | 0.31772 | −0.028331 | 0.32557 | 0.41435 | 0.3239 |
| 0.21988 | 0.24256 | 0.04644 | 0.24183 | −0.16863 | 0.064662 |
| 0.050721 | 0.37212 | −0.15632 | 0.15953 | 0.17396 | 0.27179 |
| 0.28833 | 0.17701 | 0.10953 | −0.12566 | 0.25222 | 0.028165 |
| −0.185 | 0.103 | 0.31411 | 0.028625 | 0.044214 | 0.10914 |
| −0.0045514 | −0.04656 | 0.077128 | −0.056533 | 0.45402 | −0.085798 |
| 0.037831 | −0.046766 | 0.18459 | 0.090155 | 0.11212 | 0.064479 |
| −0.10759 | 0.17753 | 0.062845 | 0.2151 | 0.38442 | 0.34494 |
| 0.58323 | 0.4243 | 0.038668 | −0.063419 | 0.37821 | 0.1026 |
| −0.17619 | 0.14265 | 0.25353 | 0.27342 | 0.58551 | 0.18797 |
| 0.19508 | 0.42282 | −0.086915 | −0.19626 | −0.17249 | −0.29359 |
| 0.11498 | −0.14994 | −0.12056 | 0.18233 | 0.11602 | 0.15087 |
| 0.25778 | 0.090116 | 0.045569 | 0.18623 | 0.0014438 | 0.18755 |
| 0.22779 | 0.12336 | −0.19509 | 0.063893 | −0.082906 | 0.19282 |
| 0.19868 | 0.013419 | −0.23541 | 0.24816 | 0.34767 | 0.27509 |
| −0.088647 | 0.16388 | −0.098936 | −0.044775 | −0.11933 | 0.091728 |
| 0.17542 | 0.44121 | 0.38937 | 0.2385 | −0.0028171 | 0.18879 |
| 0.31864 | 0.16171 | −0.1812 | −0.18125 | 0.089278 | 0.13645 |
| 0.15922 | −0.17011 | 0.29953 | −0.03002 | 0.026868 | 0.17262 |
| 0.038856 | 0.053625 | 0.14935 | 0.1629 | 0.40384 | 0.020061 |

TABLE 8-continued

| | | | | | |
|---|---|---|---|---|---|
| 0.22363 | 0.28109 | 0.099105 | 0.28739 | 0.091241 | 0.047312 |
| 0.73814 | 0.5084 | 0.2008 | 0.10759 | 0.17153 | 0.2335 |
| 0.21102 | 0.22271 | −0.14351 | 0.018219 | 0.38233 | 0.063746 |
| −0.052841 | −0.065962 | 0.0060854 | 0.35774 | 0.40683 | 0.19128 |
| 0.33896 | 0.38228 | 0.30645 | −0.056379 | 0.060055 | −0.068 |
| 0.0019844 | 0.16314 | 0.30096 | 0.27565 | 0.13439 | 0.21719 |
| −0.34758 | −0.12603 | −0.22028 | 0.42068 | 0.47322 | 0.15478 |
| 0.30912 | 0.64126 | −0.11171 | 0.29164 | 0.28681 | 0.35942 |
| 0.28619 | 0.30261 | −0.42416 | −0.1382 | −0.19655 | −0.36662 |
| 0.69142 | 0.2874 | 0.25939 | 0.2019 | 0.23682 | 0.189 |
| 0.080692 | 0.015033 | −0.1372 | 0.069557 | −0.059244 | 0.20823 |
| 0.35927 | 0.37383 | −0.23852 | 0.15027 | 0.22185 | 0.12574 |
| 0.00755 | 0.16368 | 0.33373 | −0.062242 | −0.054332 | 0.014004 |
| −0.023693 | 0.31923 | −0.23739 | 0.32433 | 0.41196 | 0.19808 |
| −0.12196 | −0.16136 | 0.21075 | 0.1371 | 0.018916 | 0.14327 |
| 0.67646 | 0.38445 | 0.094615 | 0.46046 | 0.24917 | 0.22361 |
| −0.12313 | −0.024719 | 0.075509 | 0.19772 | −0.22062 | 0.061196 |
| −0.17765 | −0.098348 | −0.15427 | −0.14594 | −0.036003 | −0.16463 |
| −0.2263 | 0.65349 | 0.0057021 | 0.24082 | 0.38945 | 0.16906 |
| 0.05089 | −0.00090237 | 0.019932 | −0.10659 | 0.15245 | −0.24996 |
| 0.26061 | 0.58716 | −0.20419 | 0.20245 | 0.1962 | 0.12418 |
| 0.27763 | −0.26523 | −0.13883 | 0.1166 | 0.074937 | −0.086722 |

| Raji.beta | ctrl_e2.beta | csk_veh.beta | final_rank_score | p.select | fdr |
|---|---|---|---|---|---|
| 0.043317 | −0.29775 | −0.86341 | −14.11681832 | 1.12E−05 | 0.006052962 |
| −0.39973 | −0.87587 | −1.4084 | −13.76014338 | 1.56E−05 | 0.006052962 |
| 0.25912 | −1.2017 | −1.0725 | −12.66153109 | 4.33E−05 | 0.006847 |
| 0.13867 | −0.73629 | −0.99369 | −12.64828586 | 4.39E−05 | 0.006847 |
| 0.29055 | −0.52036 | −0.92941 | −12.50026294 | 5.03E−05 | 0.006847 |
| 0.072181 | −0.94614 | −1.0946 | −12.22974867 | 6.46E−05 | 0.006847 |
| 0.021737 | −0.76243 | −0.72973 | −12.22327616 | 6.50E−05 | 0.006847 |
| 0.24914 | −0.30886 | −0.55572 | −12.13384835 | 7.06E−05 | 0.006847 |
| 0.154 | 0.055049 | −0.27741 | −11.85356823 | 9.14E−05 | 0.007405388 |
| 0.022858 | −0.51933 | −0.59617 | −11.80711576 | 9.54E−05 | 0.007405388 |
| 0.25784 | −0.37507 | −0.85014 | −11.2424469 | 0.000160448 | 0.01131891 |
| −0.0055012 | −0.24555 | −0.51212 | −10.91291111 | 0.000217071 | 0.012405495 |
| 0.093974 | −0.36476 | −0.54875 | −10.88940759 | 0.000221794 | 0.012405495 |
| −0.061658 | −0.10704 | −0.56379 | −10.77749634 | 0.000245723 | 0.012405495 |
| 0.36305 | −0.42523 | −0.54192 | −10.76616264 | 0.000248285 | 0.012405495 |
| 0.30057 | −0.64026 | −0.85529 | −10.73363944 | 0.000255783 | 0.012405495 |
| 0.3699 | −0.79674 | −0.81998 | −10.55334013 | 0.000301613 | 0.013164516 |
| 0.092731 | −0.18519 | −0.51825 | −10.38153249 | 0.000352824 | 0.013164516 |
| 0.2001 | −0.43915 | −0.76986 | −10.33947022 | 0.000366621 | 0.013164516 |
| −0.030025 | −0.38201 | −0.60655 | −10.27506451 | 0.00038879 | 0.013164516 |
| 0.0030072 | −0.18323 | −0.57366 | −10.26454532 | 0.000392535 | 0.013164516 |
| 0.10358 | −0.48524 | −0.54078 | −10.26272714 | 0.000393186 | 0.013164516 |
| −0.20361 | −0.39956 | −0.69758 | −10.24740462 | 0.000398714 | 0.013164516 |
| 0.28138 | −0.65888 | −0.81069 | −10.20937722 | 0.000412767 | 0.013164516 |
| 0.059677 | −0.28716 | −0.69361 | −10.15193783 | 0.000434933 | 0.013164516 |
| 0.2523 | −0.11503 | −0.6628 | −10.12453285 | 0.000445916 | 0.013164516 |
| 0.13312 | 0.72351 | −0.68848 | −10.09504445 | 0.000458044 | 0.013164516 |
| 0.35828 | −0.069812 | −0.26808 | −9.861560283 | 0.000566332 | 0.015008264 |
| 0.13529 | −0.23866 | −0.38297 | −9.820213418 | 0.000587992 | 0.015008264 |
| −0.25445 | −0.47368 | −0.8417 | −9.780368269 | 0.00060964 | 0.015008264 |
| 0.030893 | −0.44763 | −0.65287 | −9.751356703 | 0.000625897 | 0.015008264 |
| 0.10492 | −0.47735 | −0.87491 | −9.73908661 | 0.000632901 | 0.015008264 |
| 0.13124 | −0.43467 | −0.60238 | −9.710011969 | 0.000649808 | 0.015008264 |
| 0.093933 | 0.071876 | −0.53231 | −9.608709847 | 0.000712284 | 0.015008264 |
| 0.10057 | −0.60051 | −0.79014 | −9.594874476 | 0.000721265 | 0.015008264 |
| 0.23127 | −0.11391 | −0.39077 | −9.594564013 | 0.000721468 | 0.015008264 |
| 0.31653 | −0.042049 | −0.4519 | −9.565124261 | 0.000740749 | 0.015008264 |
| 0.26338 | −0.47049 | −0.71994 | −9.529957591 | 0.000764925 | 0.015008264 |
| 0.25339 | −0.32246 | −0.53148 | −9.516517112 | 0.000774285 | 0.015008264 |
| 0.16597 | −0.19424 | −0.5997 | −9.478697034 | 0.000801238 | 0.015008264 |
| 0.20055 | −0.3417 | −0.84532 | −9.46913614 | 0.000808197 | 0.015008264 |
| 0.36104 | −0.81074 | −0.68938 | −9.435613448 | 0.000833073 | 0.015008264 |
| −0.10835 | −0.010781 | −0.6186 | −9.39787312 | 0.000861986 | 0.015008264 |
| 0.37811 | −0.10342 | −0.43937 | −9.390189323 | 0.000867993 | 0.015008264 |
| −0.054924 | −0.12853 | −0.50384 | −9.387220556 | 0.000870325 | 0.015008264 |
| −0.048802 | −0.5338 | −0.60585 | −9.227436362 | 0.001005407 | 0.016960786 |
| 0.17012 | −0.094619 | −0.39199 | −9.135906128 | 0.001091915 | 0.017674453 |
| 0.33354 | 0.024246 | −0.65695 | −9.106183026 | 0.001121559 | 0.017674453 |
| −0.08812 | 0.11453 | −0.56108 | −9.057665008 | 0.001171664 | 0.017674453 |
| −0.029095 | −0.80129 | −1.0873 | −9.027283829 | 0.001204159 | 0.017674453 |
| 0.01387 | −0.41977 | −0.52939 | −9.026755893 | 0.001204731 | 0.017674453 |
| 0.051649 | −0.038869 | −0.40483 | −9.007243079 | 0.001226079 | 0.017674453 |
| 0.24814 | −0.66584 | −0.63999 | −9.003755379 | 0.001229934 | 0.017674453 |
| 0.10355 | −0.0051792 | −0.37764 | −8.984302577 | 0.001251655 | 0.017674453 |
| 0.35584 | 0.040872 | −0.25902 | −8.983375597 | 0.0012527 | 0.017674453 |

TABLE 8-continued

| | | | | | |
|---|---|---|---|---|---|
| 0.017671 | −0.3042 | −0.47706 | −8.960723063 | 0.001278493 | 0.017716257 |
| 0.20356 | −0.31316 | −0.58641 | −8.894148572 | 0.001357372 | 0.01774789 |
| 0.17158 | −0.62605 | −0.8165 | −8.872353912 | 0.001384224 | 0.01774789 |
| 0.074354 | −0.73812 | −0.51678 | −8.852205481 | 0.001409514 | 0.01774789 |
| 0.13446 | −0.46391 | −0.66435 | −8.844954938 | 0.001418726 | 0.01774789 |
| 0.12582 | −0.32951 | −0.49454 | −8.823944314 | 0.001445758 | 0.01774789 |
| 0.19284 | −0.33159 | −0.60486 | −8.822867617 | 0.001447157 | 0.01774789 |
| 0.26692 | −0.20992 | −0.61049 | −8.816716832 | 0.001455174 | 0.01774789 |
| 0.14762 | −0.38557 | −0.39609 | −8.810178539 | 0.001463744 | 0.01774789 |
| 0.26783 | −0.5784 | −0.9015 | −8.754018238 | 0.001539436 | 0.018111462 |
| −0.033956 | −0.25721 | −0.58655 | −8.753315321 | 0.001540408 | 0.018111462 |
| 0.0040584 | −0.40135 | −0.59781 | −8.703451811 | 0.001610887 | 0.018657441 |
| −0.044338 | −0.38087 | −0.64583 | −8.603072804 | 0.001762557 | 0.018987486 |
| 0.18853 | −0.36582 | −0.59999 | −8.600628413 | 0.001766421 | 0.018987486 |
| 0.047041 | −0.41234 | −0.53516 | −8.588325045 | 0.001785996 | 0.018987486 |
| −0.025612 | −0.18623 | −0.58279 | −8.585859791 | 0.001789944 | 0.018987486 |
| 0.27976 | −0.36078 | −0.63578 | −8.576451536 | 0.001805091 | 0.018987486 |
| 0.26871 | −0.35739 | −0.61361 | −8.576311364 | 0.001805317 | 0.018987486 |
| 0.098906 | −0.22842 | −0.6522 | −8.555971868 | 0.001838499 | 0.018987486 |
| 0.43839 | −0.43791 | −0.69595 | −8.550438668 | 0.00184763 | 0.018987486 |
| 0.044701 | −0.55035 | −0.73079 | −8.543225888 | 0.001859599 | 0.018987486 |
| −0.24029 | −0.40213 | −0.5072 | −8.524499605 | 0.001891033 | 0.01905768 |
| 0.14973 | −0.22929 | −0.42847 | −8.460526854 | 0.00200242 | 0.019426346 |
| 0.23086 | −0.33815 | −0.3791 | −8.453114069 | 0.002015738 | 0.019426346 |
| 0.36169 | −0.10719 | −0.26402 | −8.447627291 | 0.002025652 | 0.019426346 |
| 0.1466 | −0.33314 | −0.73168 | −8.446469527 | 0.00202775 | 0.019426346 |
| 0.28615 | 0.2327 | −0.34929 | −8.364563192 | 0.002181744 | 0.020646753 |
| −0.23663 | −0.28101 | −0.6563 | −8.350016335 | 0.002210275 | 0.020664742 |
| 0.28503 | −0.36253 | −0.77646 | −8.332773382 | 0.00224457 | 0.020735555 |
| 0.29431 | 0.0044514 | −0.70864 | −8.317725666 | 0.002274928 | 0.020749727 |
| −0.01433 | −0.32585 | −0.51055 | −8.298687273 | 0.002313916 | 0.020749727 |
| 0.31485 | −0.29648 | −0.53768 | −8.292695237 | 0.002326322 | 0.020749727 |
| 0.33399 | −0.11023 | −0.42777 | −8.252294686 | 0.002411701 | 0.020963111 |
| 0.29741 | −0.16985 | −0.35067 | −8.23429211 | 0.002450733 | 0.020963111 |
| 0.21589 | −0.27956 | −0.54725 | −8.233336772 | 0.002452822 | 0.020963111 |
| 0.31337 | −0.597 | −0.50379 | −8.230833344 | 0.002458303 | 0.020963111 |
| 0.24644 | −0.24856 | −0.68835 | −8.217880331 | 0.002486858 | 0.020976106 |
| 0.013233 | −0.3358 | −0.22221 | −8.195048422 | 0.002537989 | 0.021058589 |
| 0.18639 | −0.15524 | −0.44633 | −8.184629974 | 0.002561663 | 0.021058589 |
| 0.025144 | −0.39157 | −0.59959 | −8.177474478 | 0.002578049 | 0.021058589 |
| 0.20405 | −0.073943 | −0.33871 | −8.135404109 | 0.002676496 | 0.021256267 |
| 0.19993 | −0.022465 | −0.55886 | −8.132432339 | 0.002683589 | 0.021256267 |
| −0.047166 | −0.33679 | −0.65846 | −8.117704532 | 0.002719013 | 0.021256267 |
| 0.22655 | −0.25227 | −0.42938 | −8.092506349 | 0.002780691 | 0.021256267 |
| 0.099534 | −0.43412 | −0.776 | −8.080141431 | 0.002811459 | 0.021256267 |
| 0.19923 | 0.017136 | −0.436 | −8.076478579 | 0.002820638 | 0.021256267 |
| −0.14892 | −0.68877 | −0.78779 | −8.07520399 | 0.002823839 | 0.021256267 |
| 0.20216 | −0.50031 | −0.29872 | −8.062496352 | 0.002855947 | 0.021256267 |
| 0.035916 | −0.14789 | −0.38361 | −8.039897176 | 0.002913939 | 0.021256267 |
| 0.048477 | −0.31756 | −0.43176 | −8.02460387 | 0.00295384 | 0.021256267 |
| 0.33948 | −0.52065 | −0.52738 | −8.018278657 | 0.002970499 | 0.021256267 |
| −0.0061896 | −0.024238 | −0.3902 | −8.017108138 | 0.002973593 | 0.021256267 |
| −0.17706 | −0.32252 | −0.4576 | −7.987379142 | 0.003053222 | 0.021256267 |
| 0.1831 | −0.15526 | −0.36854 | −7.982878125 | 0.00306546 | 0.021256267 |
| 0.014065 | −0.80957 | −0.85275 | −7.982738762 | 0.003065839 | 0.021256267 |
| 0.13682 | −0.2578 | −0.56715 | −7.977503512 | 0.003080136 | 0.021256267 |
| 0.24289 | −0.35437 | −0.55103 | −7.974780915 | 0.003087596 | 0.021256267 |
| 0.12783 | 0.020337 | −0.47374 | −7.952601668 | 0.00314904 | 0.021256267 |
| 0.014567 | −0.46333 | −0.52102 | −7.952271193 | 0.003149965 | 0.021256267 |
| 0.25359 | −0.233 | −0.34368 | −7.952226137 | 0.003150091 | 0.021256267 |
| 0.30866 | −0.37585 | −0.57802 | −7.937985449 | 0.003190189 | 0.021341262 |
| 0.25013 | −0.37374 | −0.66493 | −7.92714715 | 0.003221042 | 0.021363494 |
| 0.3279 | −0.19634 | −0.3273 | −7.889096583 | 0.003331705 | 0.021543591 |
| 0.17451 | −0.43866 | −0.44403 | −7.884910725 | 0.003344105 | 0.021543591 |
| 0.059712 | −0.28638 | −0.38181 | −7.866746558 | 0.003398441 | 0.021543591 |
| 0.03644 | −0.46666 | −0.68991 | −7.863511623 | 0.003408208 | 0.021543591 |
| 0.40253 | −0.21257 | −0.42522 | −7.858384743 | 0.003423745 | 0.021543591 |
| 0.17638 | −0.3134 | −0.3905 | −7.850431331 | 0.003447985 | 0.021543591 |
| 0.25276 | −0.38709 | −0.66269 | −7.844480543 | 0.003466233 | 0.021543591 |
| 0.42583 | −0.51742 | −0.55304 | −7.843159948 | 0.003470295 | 0.021543591 |
| 0.18394 | −0.10979 | −0.46834 | −7.804629894 | 0.003590901 | 0.022115389 |
| 0.47656 | −0.32575 | −0.74609 | −7.789340826 | 0.003639893 | 0.022163147 |
| 0.12717 | 0.01041 | −0.50492 | −7.784427186 | 0.003655777 | 0.022163147 |
| 0.12646 | −0.58606 | −0.55481 | −7.73764054 | 0.003810479 | 0.022921952 |
| −0.029626 | −0.25684 | −0.61915 | −7.71903189 | 0.003873783 | 0.023007257 |
| 0.050085 | −0.31785 | −0.42778 | −7.701768124 | 0.003933436 | 0.023007257 |
| 0.11076 | −0.17431 | −0.26816 | −7.697661342 | 0.003947759 | 0.023007257 |
| 0.12635 | 0.027379 | −0.31841 | −7.685947432 | 0.003988895 | 0.023007257 |
| 0.18832 | −0.22396 | −0.45548 | −7.681148837 | 0.004005868 | 0.023007257 |
| 0.10836 | −0.018843 | −0.57248 | −7.674676322 | 0.004028874 | 0.023007257 |

TABLE 8-continued

| | | | | | |
|---|---|---|---|---|---|
| 0.1736 | −0.45207 | −0.40334 | −7.67374372 | 0.0040322 | 0.023007257 |
| 0.26249 | 0.071896 | −0.35184 | −7.662158986 | 0.004073735 | 0.023045301 |
| 0.16593 | −0.020804 | −0.37687 | −7.655372466 | 0.004098262 | 0.023045301 |
| 0.11126 | 0.0091172 | −0.29981 | −7.617933943 | 0.0042362 | 0.023528325 |
| 0.026708 | −0.52332 | −0.5375 | −7.614081821 | 0.004250649 | 0.023528325 |
| 0.33689 | −0.17611 | −0.39381 | −7.607410682 | 0.004275787 | 0.023528325 |
| 0.13633 | −0.28994 | −0.49596 | −7.599590277 | 0.004305441 | 0.023528325 |
| 0.24367 | −0.23183 | −0.30284 | −7.588625468 | 0.004347359 | 0.023529148 |
| 0.21194 | −0.31661 | −0.51332 | −7.580903422 | 0.00437712 | 0.023529148 |
| −0.04193 | −0.024177 | −0.35715 | −7.572187309 | 0.004410954 | 0.023529148 |
| 0.021233 | −0.08678 | −0.63474 | −7.568108139 | 0.004426876 | 0.023529148 |
| −0.20717 | −0.67825 | −0.84539 | −7.555848275 | 0.00447507 | 0.0236235 |
| 0.23843 | −0.1649 | −0.36715 | −7.539831575 | 0.004538811 | 0.023798088 |
| 0.19185 | −0.6772 | −0.45838 | −7.52640935 | 0.004592912 | 0.023872279 |
| 5.33E−05 | 0.01422 | −0.42698 | −7.518893347 | 0.004623483 | 0.023872279 |
| 0.068464 | −0.47179 | −0.63682 | −7.513571603 | 0.00464525 | 0.023872279 |
| 0.074238 | −0.17262 | −0.51918 | −7.503165682 | 0.004688103 | 0.023934002 |
| 0.10298 | 0.2156 | −0.30584 | −7.470205196 | 0.004826419 | 0.024304683 |
| −0.040034 | −0.4101 | −0.60964 | −7.46591112 | 0.004844731 | 0.024304683 |
| 0.15909 | −0.3691 | −0.56706 | −7.463586695 | 0.004854672 | 0.024304683 |
| 0.39909 | −0.078264 | −0.42983 | −7.443700972 | 0.004940542 | 0.024576029 |
| 0.17374 | −0.053133 | −0.24761 | −7.428072294 | 0.005009074 | 0.024758225 |
| 0.21313 | −0.18566 | −0.26575 | −7.409606761 | 0.005091249 | 0.024912821 |
| 0.19915 | −0.20836 | −0.38883 | −7.406643279 | 0.00510456 | 0.024912821 |
| 0.3183 | 0.11583 | −0.42896 | −7.397805166 | 0.00514446 | 0.024950633 |
| 0.050687 | −0.39546 | −0.71813 | −7.368561328 | 0.005278679 | 0.025041351 |
| 0.0056835 | −0.12054 | −0.60077 | −7.367924801 | 0.005281639 | 0.025041351 |
| 0.15343 | −0.44727 | −0.4972 | −7.363463753 | 0.005302425 | 0.025041351 |
| 0.08181 | −0.19594 | −0.45131 | −7.351375734 | 0.005359152 | 0.025041351 |
| 0.11252 | −0.055344 | −0.41811 | −7.347512631 | 0.005377407 | 0.025041351 |
| 0.30442 | 0.24453 | −0.23385 | −7.345865083 | 0.005385211 | 0.025041351 |
| 0.17738 | 0.24062 | −0.46635 | −7.345054601 | 0.005389054 | 0.025041351 |
| −0.050027 | −0.11458 | −0.54461 | −7.337286099 | 0.005426026 | 0.025063071 |
| 0.1043 | −0.60471 | −0.57437 | −7.308370485 | 0.005565842 | 0.025214095 |
| 0.17052 | 0.055343 | −0.43668 | −7.304119682 | 0.005586692 | 0.025214095 |
| 0.11105 | −0.25311 | −0.29852 | −7.299534945 | 0.005609266 | 0.025214095 |
| 0.19687 | 0.27838 | −0.29669 | −7.299300396 | 0.005610423 | 0.025214095 |
| 0.26332 | −0.3558 | −0.3705 | −7.29712172 | 0.005621184 | 0.025214095 |
| 0.40907 | −0.044701 | −0.28442 | −7.273220683 | 0.00574057 | 0.025601622 |
| 0.028772 | −0.19199 | −0.64461 | −7.260927928 | 0.005802938 | 0.025613637 |
| 0.089367 | −0.41475 | −0.69673 | −7.257480775 | 0.005820546 | 0.025613637 |
| 0.3374 | −0.31453 | −0.26599 | −7.253238868 | 0.005842286 | 0.025613637 |
| 0.21927 | −0.21631 | −0.35811 | −7.245475131 | 0.005882282 | 0.025644104 |
| 0.20645 | −0.21795 | −0.28146 | −7.238344739 | 0.005919251 | 0.025661112 |
| 0.1268 | −0.33037 | −0.51883 | −7.228682828 | 0.00596971 | 0.025736085 |
| 0.13031 | −0.22771 | −0.45371 | −7.213903308 | 0.006047713 | 0.025928317 |
| 0.15991 | −0.28216 | −0.46196 | −7.202683435 | 0.006107596 | 0.025986008 |
| −0.072721 | −0.23788 | −0.53041 | −7.19241665 | 0.006162901 | 0.025986008 |
| 0.0011914 | −0.45594 | −0.46162 | −7.183840952 | 0.006209472 | 0.025986008 |
| 0.35768 | −0.49799 | −0.45163 | −7.183729519 | 0.00621008 | 0.025986008 |
| −0.22751 | −0.17648 | −0.60935 | −7.177564374 | 0.006243777 | 0.025986008 |
| 0.053122 | −0.20643 | −0.33156 | −7.168058207 | 0.006296087 | 0.025986008 |
| −0.33475 | −0.20832 | −0.56304 | −7.168058207 | 0.006296087 | 0.025986008 |
| 0.28026 | −0.13666 | −0.39937 | −7.158913258 | 0.006346814 | 0.025986008 |
| 0.043908 | −0.4562 | −0.68798 | −7.141164101 | 0.006446416 | 0.025986008 |
| 0.078964 | 0.11075 | −0.4246 | −7.135533808 | 0.00647833 | 0.025986008 |
| 0.3492 | −0.090616 | −0.45161 | −7.134751009 | 0.00648278 | 0.025986008 |
| −0.005362 | −0.32284 | −0.49463 | −7.134286925 | 0.006485419 | 0.025986008 |
| 0.30531 | −0.22472 | −0.57907 | −7.132340124 | 0.006496502 | 0.025986008 |
| 0.05467 | −0.030457 | −0.36097 | −7.115260491 | 0.006594534 | 0.026199906 |
| 0.15616 | −0.4588 | −0.57087 | −7.111294846 | 0.006617502 | 0.026199906 |
| 0.14367 | 0.10064 | −0.3608 | −7.077621331 | 0.006815718 | 0.026588242 |
| 0.085316 | 0.051947 | −0.47018 | −7.067451878 | 0.006876715 | 0.026588242 |
| 0.014119 | −0.17355 | −0.44787 | −7.064740088 | 0.006893071 | 0.026588242 |
| 0.061228 | −0.10698 | −0.34935 | −7.057789967 | 0.006935164 | 0.026588242 |
| 0.31528 | −0.055476 | −0.43079 | −7.055759659 | 0.006947507 | 0.026588242 |
| 0.3387 | −0.35471 | −0.29024 | −7.053452204 | 0.006961562 | 0.026588242 |
| −0.43581 | −0.33958 | −0.64786 | −7.042870867 | 0.007026372 | 0.026588242 |
| 0.16669 | −0.40061 | −0.32498 | −7.042580549 | 0.007028159 | 0.026588242 |
| −0.093249 | −0.50005 | −0.57129 | −7.037417317 | 0.007060005 | 0.026588242 |
| 0.028094 | −0.30307 | −0.58042 | −7.0333346 | 0.007085287 | 0.026588242 |
| 0.06809 | −0.426 | −0.55315 | −7.029319209 | 0.007110239 | 0.026588242 |
| 0.18663 | −0.50014 | −0.50095 | −7.02460092 | 0.007139668 | 0.026588242 |
| 0.087522 | −0.15825 | −0.45578 | −7.021191439 | 0.007161008 | 0.026588242 |
| 0.28114 | −0.20739 | −0.38026 | −7.01005997 | 0.007231117 | 0.0267207 |
| 0.088877 | −0.25652 | −0.30008 | −6.995242818 | 0.007325484 | 0.026787681 |
| 0.24444 | −0.37045 | −0.36923 | −6.994153295 | 0.00733247 | 0.026787681 |
| 0.082635 | −0.078261 | −0.46124 | −6.988310919 | 0.007370044 | 0.026787681 |
| 0.83796 | −0.32954 | −0.64702 | −6.985633817 | 0.007387324 | 0.026787681 |
| −0.016023 | −0.39507 | −0.37335 | −6.975584509 | 0.007452546 | 0.026867903 |

TABLE 8-continued

| | | | | | |
|---|---|---|---|---|---|
| −0.11164 | −0.15692 | −0.58967 | −6.961890512 | 0.007542331 | 0.026867903 |
| 0.1141 | 0.029173 | −0.26014 | −6.960741978 | 0.007549909 | 0.026867903 |
| −0.016606 | −0.23074 | −0.5065 | −6.956283021 | 0.007579401 | 0.026867903 |
| 0.27334 | −0.15337 | −0.37757 | −6.952213958 | 0.007606413 | 0.026867903 |
| 0.16982 | −0.11732 | −0.45698 | −6.946215377 | 0.007646405 | 0.026867903 |
| 0.21688 | −0.071898 | −0.31941 | −6.935074296 | 0.00772123 | 0.026867903 |
| 0.071526 | −0.28284 | −0.52952 | −6.932774198 | 0.007736767 | 0.026867903 |
| −0.098682 | −0.41601 | −0.54091 | −6.927316406 | 0.007773756 | 0.026867903 |
| 0.060168 | −0.33331 | −0.35782 | −6.925308314 | 0.007787409 | 0.026867903 |
| 0.19558 | −0.14968 | −0.27361 | −6.909371233 | 0.0078966 | 0.026867903 |
| −0.0063756 | −0.11854 | −0.47382 | −6.90588909 | 0.007920657 | 0.026867903 |
| −0.12594 | 0.03142 | −0.43141 | −6.899301524 | 0.007966363 | 0.026867903 |
| 0.048907 | −0.45471 | −0.65219 | −6.894022922 | 0.008003174 | 0.026867903 |
| 0.1855 | −0.013813 | −0.33013 | −6.890038045 | 0.008031073 | 0.026867903 |
| 0.11195 | −0.66981 | −0.46187 | −6.88937371 | 0.008035734 | 0.026867903 |
| 0.19667 | −0.11958 | −0.33794 | −6.88473052 | 0.008068381 | 0.026867903 |
| 0.14416 | −0.54464 | −0.65067 | −6.878116246 | 0.008115111 | 0.026867903 |
| 0.097934 | −0.099747 | −0.47289 | −6.876066225 | 0.008129648 | 0.026867903 |
| −0.18443 | −0.15332 | −0.35435 | −6.865625324 | 0.008204083 | 0.026867903 |
| 0.33773 | −0.53179 | −0.42516 | −6.864926374 | 0.00820909 | 0.026867903 |
| 0.40568 | −0.064276 | −0.35539 | −6.86425827 | 0.008213879 | 0.026867903 |
| 0.052381 | 0.020988 | −0.2608 | −6.861529755 | 0.008233463 | 0.026867903 |
| 0.12272 | −0.12717 | −0.33189 | −6.854750887 | 0.008282319 | 0.026867903 |
| 0.19687 | −0.072127 | −0.59753 | −6.853568794 | 0.008290867 | 0.026867903 |
| 0.097195 | 0.046944 | −0.42386 | −6.850974098 | 0.008309661 | 0.026867903 |
| 0.02686 | −0.080203 | −0.35285 | −6.840676942 | 0.008384657 | 0.0269979 |
| 0.10033 | −0.18114 | −0.33844 | −6.830861467 | 0.008456762 | 0.02711755 |
| −0.12924 | 0.2702 | −0.37654 | −6.800327098 | 0.008684969 | 0.027734716 |
| 0.21184 | −0.26841 | −0.36083 | −6.789366351 | 0.008768348 | 0.02778206 |
| 0.11401 | −0.41226 | −0.46193 | −6.788967388 | 0.008771398 | 0.02778206 |
| −0.0043516 | −0.13585 | −0.36924 | −6.78307661 | 0.008816548 | 0.027811549 |
| 0.20899 | −0.23012 | −0.25671 | −6.767651807 | 0.008935851 | 0.027996671 |
| 0.080541 | −0.31176 | −0.37553 | −6.76488101 | 0.008957448 | 0.027996671 |
| 0.12195 | −0.26528 | −0.47042 | −6.761551546 | 0.008983468 | 0.027996671 |
| 0.32754 | −0.070675 | −0.21554 | −6.748767094 | 0.009084066 | 0.028041234 |
| 0.052254 | 0.063384 | −0.39413 | −6.748694971 | 0.009084637 | 0.028041234 |
| 0.17469 | −0.19539 | −0.40712 | −6.745976135 | 0.009106174 | 0.028041234 |
| 0.098128 | −0.21714 | −0.36307 | −6.7384123 | 0.009166353 | 0.02811498 |
| −0.15282 | −0.040884 | −0.42835 | −6.731042526 | 0.009225362 | 0.028179768 |
| 0.16808 | 0.20523 | −0.24734 | −6.72672508 | 0.009260104 | 0.028179768 |
| −0.2656 | −0.35369 | −0.52045 | −6.71244791 | 0.009375904 | 0.028315371 |
| 0.14882 | −0.20196 | −0.42239 | −6.712234927 | 0.009377642 | 0.028315371 |
| 0.15137 | −0.44538 | −0.44166 | −6.705197296 | 0.009435254 | 0.028378902 |
| 0.0045789 | −0.30885 | −0.38101 | −6.69152003 | 0.00954821 | 0.028607764 |
| −0.12665 | 0.0022093 | −0.33987 | −6.675807991 | 0.009679603 | 0.028727739 |
| 0.17923 | −0.10347 | −0.26921 | −6.669716602 | 0.009731016 | 0.028727739 |
| −0.055539 | −0.4991 | −0.50764 | −6.66906704 | 0.009736515 | 0.028727739 |
| 0.34484 | −0.23738 | −0.24847 | −6.664519454 | 0.009775093 | 0.028727739 |
| 0.17228 | −0.070184 | −0.29746 | −6.660314249 | 0.0098109 | 0.028727739 |
| 0.10081 | −0.19747 | −0.31978 | −6.654607483 | 0.009859698 | 0.028727739 |
| 0.1592 | 0.013035 | −0.46473 | −6.653381513 | 0.009870212 | 0.028727739 |
| 0.28322 | −0.14805 | −0.35879 | −6.651727402 | 0.009884415 | 0.028727739 |
| 0.24735 | −0.2891 | −0.55022 | −6.643741116 | 0.009953272 | 0.028819921 |
| 0.094148 | 0.16702 | −0.25467 | −6.637260589 | 0.01000949 | 0.028860609 |
| 0.045358 | −0.066238 | −0.31771 | −6.632136725 | 0.010054159 | 0.028860609 |
| 0.18295 | −0.26579 | −0.39589 | −6.629308548 | 0.010078898 | 0.028860609 |
| 0.23056 | −0.41368 | −0.36284 | −6.621411306 | 0.010148293 | 0.028952484 |
| −0.048986 | 0.05015 | −0.32427 | −6.610328586 | 0.010246468 | 0.029034478 |
| −0.21082 | −0.02463 | −0.4571 | −6.60803115 | 0.010266935 | 0.029034478 |
| −0.0051343 | −0.28502 | −0.56892 | −6.60552802 | 0.01028928 | 0.029034478 |
| 0.0072203 | −0.039528 | −0.30974 | −6.585112835 | 0.010473308 | 0.029446692 |
| 0.11617 | −0.11756 | −0.48557 | −6.576196792 | 0.010554685 | 0.029495532 |
| 0.24951 | −0.0090627 | −0.38016 | −6.572803723 | 0.010585815 | 0.029495532 |
| 0.085239 | −0.022006 | −0.35605 | −6.570749249 | 0.010604708 | 0.029495532 |
| 0.1527 | −0.023957 | −0.34169 | −6.563921333 | 0.010667734 | 0.029564864 |
| 0.18709 | −0.31066 | −0.30853 | −6.55910673 | 0.010712396 | 0.029567719 |
| −0.099121 | −0.25748 | −0.3428 | −6.555607542 | 0.01074497 | 0.029567719 |
| −0.073187 | −0.22438 | −0.37622 | −6.551276605 | 0.010785421 | 0.029574158 |
| −0.14846 | −0.6135 | −0.49303 | −6.542157172 | 0.010871083 | 0.029683998 |
| 0.20102 | −0.11079 | −0.38668 | −6.538884781 | 0.010901984 | 0.029683998 |
| 0.17789 | −0.39484 | −0.52628 | −6.531754925 | 0.010969607 | 0.029697875 |
| −0.096027 | −0.32147 | −0.52197 | −6.528046281 | 0.011004943 | 0.029697875 |
| −0.00055136 | −0.094638 | −0.3424 | −6.521682456 | 0.011065838 | 0.029697875 |
| 0.11801 | −0.20754 | −0.40683 | −6.520031461 | 0.011081689 | 0.029697875 |
| 0.15309 | −0.33118 | −0.43617 | −6.518290106 | 0.011098433 | 0.029697875 |
| 0.28567 | −0.19044 | −0.46008 | −6.502826896 | 0.011248202 | 0.029795947 |
| 0.20156 | −0.18093 | −0.45709 | −6.502203168 | 0.011254284 | 0.029795947 |
| 0.00011643 | −0.029261 | −0.3531 | −6.500731726 | 0.011268645 | 0.029795947 |
| 0.22138 | −0.1358 | −0.46035 | −6.498683059 | 0.011288671 | 0.029795947 |
| 0.21103 | −0.040026 | −0.22791 | −6.483102997 | 0.011442103 | 0.03009855 |

TABLE 8-continued

| | | | | | |
|---|---|---|---|---|---|
| 0.14504 | −0.06414 | −0.44704 | −6.4680547 | 0.011592231 | 0.030304461 |
| −0.020778 | −0.14037 | −0.48831 | −6.467431866 | 0.011598486 | 0.030304461 |
| 0.23358 | 0.17967 | −0.20842 | −6.455738398 | 0.011716532 | 0.030459029 |
| 0.1427 | 0.1079 | −0.30548 | −6.453806627 | 0.011736146 | 0.030459029 |
| −0.052626 | −0.46901 | −0.43917 | −6.438425859 | 0.01189346 | 0.030666595 |
| 0.097519 | −0.18222 | −0.42493 | −6.438260616 | 0.011895161 | 0.030666595 |
| −0.0039378 | −0.19981 | −0.34946 | −6.427954043 | 0.012001741 | 0.03083891 |
| 0.033931 | −0.035437 | −0.41667 | −6.414659111 | 0.0121406 | 0.031092757 |
| −0.22956 | −0.61233 | −0.53149 | −6.405589126 | 0.012236229 | 0.031234585 |
| 0.13656 | 0.12771 | −0.26067 | −6.386226213 | 0.012442848 | 0.031586761 |
| 0.2785 | −0.52944 | −0.50521 | −6.383359944 | 0.012473721 | 0.031586761 |
| 0.07503 | −0.0766 | −0.55414 | −6.379900057 | 0.012511088 | 0.031586761 |
| −0.13698 | −0.31963 | −0.5029 | −6.372112407 | 0.012595595 | 0.031586761 |
| −0.042453 | −0.25439 | −0.43778 | −6.370999523 | 0.012607717 | 0.031586761 |
| 0.31988 | −0.3241 | −0.39824 | −6.370017505 | 0.012618423 | 0.031586761 |
| −0.026252 | −0.2048 | −0.28531 | −6.35880528 | 0.012741286 | 0.031597637 |
| 0.30618 | −0.10078 | −0.28002 | −6.342562974 | 0.012921341 | 0.031597637 |
| 0.23668 | 0.17193 | −0.36934 | −6.338439356 | 0.012967447 | 0.031597637 |
| −0.050649 | 0.057944 | −0.34454 | −6.338283854 | 0.012969189 | 0.031597637 |
| −0.061828 | 0.056392 | −0.32503 | −6.337638184 | 0.012976423 | 0.031597637 |
| 0.17779 | −0.23423 | −0.29148 | −6.336097434 | 0.012993703 | 0.031597637 |
| −0.23876 | −0.39068 | −0.59145 | −6.335023897 | 0.013005756 | 0.031597637 |
| 0.26195 | −0.22028 | −0.50489 | −6.333609185 | 0.013021657 | 0.031597637 |
| −0.097495 | −0.2557 | −0.46394 | −6.332850533 | 0.013030191 | 0.031597637 |
| 0.12242 | 0.053933 | −0.21519 | −6.325068254 | 0.013118055 | 0.031597637 |
| 0.033626 | 0.0092573 | −0.20597 | −6.324667009 | 0.0131226 | 0.031597637 |
| −0.035482 | −0.35806 | −0.38351 | −6.324590319 | 0.013123469 | 0.031597637 |
| −0.014899 | −0.18188 | −0.36898 | −6.31722895 | 0.013207146 | 0.031597637 |
| 0.28272 | −0.17016 | −0.27183 | −6.31633927 | 0.013217294 | 0.031597637 |
| 0.41308 | −0.031596 | −0.55941 | −6.308901692 | 0.013302428 | 0.031597637 |
| 0.36431 | −0.40567 | −0.54055 | −6.307694523 | 0.013316297 | 0.031597637 |
| −0.14174 | 0.2453 | −0.24889 | −6.30719583 | 0.01332203 | 0.031597637 |
| 0.22957 | −0.22454 | −0.40852 | −6.30365416 | 0.013362816 | 0.031597637 |
| −0.047625 | −0.047156 | −0.21929 | −6.299351045 | 0.013412535 | 0.031597637 |
| 0.018689 | −0.64453 | −0.53617 | −6.292692313 | 0.013489826 | 0.031597637 |
| 0.18039 | −0.080994 | −0.20217 | −6.291658644 | 0.013501863 | 0.031597637 |
| 0.14264 | −0.42193 | −0.20897 | −6.288123134 | 0.013543114 | 0.031597637 |
| 0.11138 | −0.066263 | −0.3497 | −6.286739117 | 0.013559295 | 0.031597637 |
| 0.27591 | −0.29474 | −0.35236 | −6.2821659 | 0.013612898 | 0.031610199 |
| −0.045716 | −0.12373 | −0.20985 | −6.279337251 | 0.013646156 | 0.031610199 |
| 0.13798 | −0.33484 | −0.4926 | −6.2695386 | 0.013761977 | 0.031692962 |
| 0.21433 | 0.031899 | −0.28931 | −6.269404616 | 0.013763567 | 0.031692962 |
| 0.047959 | −0.20045 | −0.41551 | −6.264573655 | 0.013821028 | 0.031731119 |
| 0.2424 | −0.0088366 | −0.23104 | −6.248607793 | 0.0140126 | 0.03207604 |
| 0.20209 | −0.23124 | −0.38952 | −6.24194884 | 0.014093262 | 0.032154547 |
| −0.050794 | −0.17615 | −0.36826 | −6.238947223 | 0.014129769 | 0.032154547 |
| 0.088891 | 0.14346 | −0.44627 | −6.21638286 | 0.014407174 | 0.03260179 |
| −0.074966 | −0.35056 | −0.42151 | −6.216128779 | 0.014410327 | 0.03260179 |
| −0.041302 | −0.2344 | −0.32313 | −6.206248671 | 0.014533483 | 0.032784833 |
| 0.10147 | −0.13815 | −0.46629 | −6.191170277 | 0.014723413 | 0.033057468 |
| 0.21415 | −0.28945 | −0.30025 | −6.189898598 | 0.014739541 | 0.033057468 |
| 0.26307 | −0.67258 | −0.23349 | −6.180053504 | 0.014864987 | 0.033102262 |
| 0.1497 | −0.15768 | −0.37607 | −6.179448726 | 0.014872727 | 0.033102262 |
| 0.37946 | −0.24396 | −0.37391 | −6.178296324 | 0.014887487 | 0.033102262 |
| 0.34127 | 0.12651 | −0.30111 | −6.160999963 | 0.015110728 | 0.033502642 |
| 0.056042 | −0.29917 | −0.34317 | −6.152210687 | 0.015225415 | 0.033646648 |
| 0.048477 | −0.35065 | −0.28917 | −6.148073505 | 0.015279692 | 0.033646648 |
| −0.12842 | −0.51175 | −0.56425 | −6.145002762 | 0.0153201 | 0.033646648 |
| 0.16164 | −0.092402 | −0.32898 | −6.142494426 | 0.015353185 | 0.033646648 |
| 0.059141 | −0.42998 | −0.30135 | −6.136503874 | 0.01543248 | 0.033646648 |
| −0.026561 | −0.3989 | −0.48321 | −6.132092785 | 0.015491124 | 0.033646648 |
| 0.36915 | −0.043134 | −0.34701 | −6.130872143 | 0.01550739 | 0.033646648 |
| 0.60165 | 0.071341 | −0.30762 | −6.129735514 | 0.015522552 | 0.033646648 |
| 0.13502 | −0.14149 | −0.37176 | −6.123864121 | 0.0156011 | 0.033722491 |
| 0.3388 | 0.14739 | −0.21524 | −6.120635778 | 0.015644455 | 0.033722491 |
| 0.076376 | −0.094568 | −0.30717 | −6.117240417 | 0.015690178 | 0.033727364 |
| 0.15548 | −0.18174 | −0.27234 | −6.112319164 | 0.015756681 | 0.033776753 |
| 0.095387 | −0.18362 | −0.32754 | −6.101710489 | 0.015900975 | 0.033930814 |
| 0.23404 | −0.33023 | −0.37862 | −6.100611225 | 0.015916 | 0.033930814 |
| 0.14705 | −0.30704 | −0.31113 | −6.090060063 | 0.016060921 | 0.034002265 |
| 0.084279 | 0.1113 | −0.29675 | −6.086571479 | 0.016109118 | 0.034002265 |
| 0.36547 | −0.03048 | −0.24853 | −6.084569532 | 0.01613684 | 0.034002265 |
| 0.14639 | −0.057151 | −0.32719 | −6.084198382 | 0.016141985 | 0.034002265 |
| 0.13301 | −0.058646 | −0.36829 | −6.082279876 | 0.016168603 | 0.034002265 |
| 0.21464 | −0.47995 | −0.38244 | −6.078188719 | 0.016225509 | 0.034029715 |
| 0.2261 | −0.22686 | −0.29234 | −6.061987173 | 0.016452782 | 0.034382134 |
| −0.0013743 | 0.38269 | −0.34073 | −6.057058948 | 0.016522527 | 0.034382134 |
| 0.12684 | 0.0055685 | −0.32952 | −6.056781355 | 0.016526464 | 0.034382134 |
| 0.012398 | −0.38 | −0.32278 | −6.052518829 | 0.016587034 | 0.034415877 |
| 0.21748 | −0.26362 | −0.24584 | −6.048111076 | 0.016649894 | 0.034431328 |

TABLE 8-continued

| | | | | | |
|---|---|---|---|---|---|
| 0.11262 | −0.33597 | −0.3304 | −6.043157102 | 0.016720821 | 0.034431328 |
| 0.287 | −0.17113 | −0.40121 | −6.042685301 | 0.016727591 | 0.034431328 |
| 0.07732 | −0.014806 | −0.25956 | −6.035754178 | 0.016827358 | 0.034545052 |
| 0.052744 | −0.21259 | −0.43452 | −6.006511246 | 0.017254689 | 0.03516532 |
| 0.24106 | −0.14789 | −0.37207 | −6.006135784 | 0.017260244 | 0.03516532 |
| 0.20235 | −0.06687 | −0.24466 | −6.003776814 | 0.017295183 | 0.03516532 |
| 0.096393 | −0.071543 | −0.41956 | −6.002621858 | 0.017312314 | 0.03516532 |
| 0.053483 | −0.12721 | −0.27221 | −5.999676347 | 0.017356079 | 0.03516532 |
| 0.29168 | −0.30524 | −0.26583 | −5.990912644 | 0.01748693 | 0.035338171 |
| 0.31303 | −0.14308 | −0.30861 | −5.980693139 | 0.017640729 | 0.035525885 |
| 0.031273 | −0.36642 | −0.37554 | −5.978666719 | 0.017671381 | 0.035525885 |
| −0.090303 | −0.28863 | −0.28081 | −5.972139137 | 0.017770472 | 0.035587901 |
| 0.33072 | −0.3304 | −0.29728 | −5.970597717 | 0.01779395 | 0.035587901 |
| 0.4035 | −0.41732 | −0.42218 | −5.963996965 | 0.017894831 | 0.035697658 |
| 0.28352 | −0.092531 | −0.2035 | −5.954381506 | 0.018042781 | 0.035827844 |
| 0.31968 | −0.11021 | −0.3513 | −5.953363572 | 0.018058513 | 0.035827844 |
| 0.37994 | −0.011179 | −0.21318 | −5.95047219 | 0.018103272 | 0.035827844 |
| −0.065019 | −0.25175 | −0.41259 | −5.947797547 | 0.018144771 | 0.035827844 |
| 0.25992 | −0.27884 | −0.28886 | −5.941829765 | 0.018237701 | 0.035892048 |
| 0.15894 | −0.054755 | −0.36417 | −5.938600496 | 0.018288179 | 0.035892048 |
| 0.3258 | −0.18221 | −0.30696 | −5.935537522 | 0.018336183 | 0.035892048 |
| 0.31458 | 0.11146 | −0.37972 | −5.933071947 | 0.018374913 | 0.035892048 |
| −0.022365 | −0.11425 | −0.38545 | −5.930934715 | 0.01840855 | 0.035892048 |
| 0.21168 | −0.070001 | −0.23417 | −5.914874179 | 0.018663241 | 0.036194038 |
| 0.091861 | −0.082551 | −0.41773 | −5.914692102 | 0.018666148 | 0.036194038 |
| 0.38625 | −0.12947 | −0.33621 | −5.912302717 | 0.018704336 | 0.036194038 |
| 0.2754 | 0.040872 | −0.27033 | −5.907731508 | 0.018777607 | 0.036194038 |
| −0.03854 | −0.20242 | −0.32803 | −5.895840651 | 0.018969512 | 0.036194038 |
| 0.34964 | −0.13545 | −0.2206 | −5.893365516 | 0.019009697 | 0.036194038 |
| 0.30489 | −0.11768 | −0.24939 | −5.891078112 | 0.019046907 | 0.036194038 |
| 0.17375 | −0.019207 | −0.24671 | −5.89021428 | 0.019060978 | 0.036194038 |
| 0.046747 | −0.45506 | −0.34584 | −5.88997743 | 0.019064837 | 0.036194038 |
| 0.26534 | −0.096891 | −0.33965 | −5.888313422 | 0.019091976 | 0.036194038 |
| 0.11711 | −0.03964 | −0.23765 | −5.886347662 | 0.019124084 | 0.036194038 |
| 0.087612 | −0.14325 | −0.3005 | −5.880172713 | 0.019225285 | 0.036194038 |
| 0.30323 | −0.42264 | −0.36756 | −5.879478875 | 0.019236688 | 0.036194038 |
| 0.2041 | −0.12089 | −0.33847 | −5.87935037 | 0.019238801 | 0.036194038 |
| 0.045903 | −0.023389 | −0.29452 | −5.877875628 | 0.019263064 | 0.036194038 |
| 0.017752 | −0.24405 | −0.34697 | −5.871882022 | 0.019361979 | 0.036292018 |
| 0.17371 | 0.050852 | −0.30831 | −5.868498532 | 0.019418035 | 0.036309386 |
| 0.14294 | −0.14563 | −0.29113 | −5.858884504 | 0.019578178 | 0.036441549 |
| 0.29373 | −0.24924 | −0.47034 | −5.85861794 | 0.019582637 | 0.036441549 |
| −0.0072861 | 0.23511 | −0.28508 | −5.851168155 | 0.019707638 | 0.036586429 |
| −0.074316 | −0.60231 | −0.35183 | −5.841922375 | 0.019863853 | 0.036664206 |
| 0.1986 | −0.22488 | −0.3877 | −5.839787686 | 0.019900091 | 0.036664206 |
| −0.047247 | −0.21047 | −0.41556 | −5.837831558 | 0.019933353 | 0.036664206 |
| 0.11379 | 0.11215 | −0.26469 | −5.829530778 | 0.020075105 | 0.036664206 |
| −0.076012 | −0.12742 | −0.42399 | −5.827217849 | 0.020114776 | 0.036664206 |
| −0.20817 | −0.32215 | −0.34915 | −5.820663754 | 0.020227606 | 0.036664206 |
| −0.0027873 | −0.22625 | −0.25132 | −5.815395926 | 0.020318738 | 0.036664206 |
| 0.22985 | −0.2447 | −0.38092 | −5.81281835 | 0.020363474 | 0.036664206 |
| 0.31686 | −0.25818 | −0.36159 | −5.812719345 | 0.020365194 | 0.036664206 |
| 0.21736 | −0.21779 | −0.3505 | −5.812599137 | 0.020367283 | 0.036664206 |
| 0.24899 | 0.0074707 | −0.26633 | −5.81148614 | 0.020386633 | 0.036664206 |
| 0.040726 | −0.14884 | −0.33093 | −5.809975859 | 0.020412919 | 0.036664206 |
| 0.028212 | −0.019341 | −0.30236 | −5.807575751 | 0.02045476 | 0.036664206 |
| 0.22658 | −0.14207 | −0.25648 | −5.80711857 | 0.020462739 | 0.036664206 |
| 0.26614 | −0.16298 | −0.20689 | −5.801669625 | 0.020558074 | 0.036664206 |
| −0.08668 | −0.33396 | −0.47587 | −5.799777863 | 0.020591273 | 0.036664206 |
| 0.29809 | −0.28809 | −0.2865 | −5.798764458 | 0.020609079 | 0.036664206 |
| 0.22084 | 0.073736 | −0.31919 | −5.796634599 | 0.02064655 | 0.036664206 |
| −0.10616 | 0.22094 | −0.4198 | −5.796595457 | 0.02064724 | 0.036664206 |
| −0.0054775 | −0.092773 | −0.26464 | −5.785737863 | 0.020839296 | 0.036844984 |
| 0.21963 | −0.21122 | −0.31414 | −5.785472896 | 0.020844005 | 0.036844984 |
| 0.17674 | −0.15899 | −0.48326 | −5.777083672 | 0.020993618 | 0.03686866 |
| 0.022869 | −0.804 | −0.34758 | −5.776454368 | 0.021004883 | 0.03686866 |
| 0.09607 | 0.055558 | −0.23791 | −5.775704495 | 0.021018314 | 0.03686866 |
| 0.076286 | −0.14017 | −0.53455 | −5.771634327 | 0.021091359 | 0.03686866 |
| −0.069744 | −0.25726 | −0.42261 | −5.771206851 | 0.021099045 | 0.03686866 |
| 0.1529 | −0.045423 | −0.35893 | −5.768794697 | 0.021142466 | 0.03686866 |
| 0.1435 | 0.31209 | −0.20625 | −5.76526489 | 0.021206162 | 0.036889263 |
| 0.34674 | −0.15076 | −0.23107 | −5.761581192 | 0.021272834 | 0.036889263 |
| 0.30452 | −0.063777 | −0.23356 | −5.757377286 | 0.021349169 | 0.036889263 |
| 0.23471 | −0.34817 | −0.39432 | −5.75528695 | 0.021387225 | 0.036889263 |
| −0.10029 | 0.078246 | −0.47438 | −5.755026591 | 0.02139197 | 0.036889263 |
| 0.27966 | −0.24223 | −0.30731 | −5.74418693 | 0.021590411 | 0.03706018 |
| 0.18667 | −0.036281 | −0.20625 | −5.743083179 | 0.021610717 | 0.03706018 |
| −0.22353 | −0.40306 | −0.53128 | −5.741799479 | 0.021634357 | 0.03706018 |
| −0.0096285 | 0.015169 | −0.45917 | −5.737336675 | 0.021716738 | 0.037119358 |
| −0.11516 | −0.093326 | −0.41071 | −5.732314427 | 0.021809809 | 0.037134476 |

TABLE 8-continued

| | | | | | |
|---|---|---|---|---|---|
| 0.069677 | −0.16611 | −0.26597 | −5.731696364 | 0.02182129 | 0.037134476 |
| 0.017766 | −0.56079 | −0.37883 | −5.72671527 | 0.021914028 | 0.03717774 |
| 0.1586 | −0.27259 | −0.33031 | −5.725188352 | 0.021942532 | 0.03717774 |
| 0.25849 | −0.43634 | −0.29252 | −5.719012129 | 0.022058197 | 0.037195456 |
| 0.0181 | −0.32432 | −0.28011 | −5.717058226 | 0.022094912 | 0.037195456 |
| 0.019181 | −0.46491 | −0.40809 | −5.716958623 | 0.022096785 | 0.037195456 |
| 0.23261 | −0.17701 | −0.30775 | −5.713072221 | 0.022169994 | 0.037237912 |
| 0.30984 | 0.11842 | −0.29297 | −5.707363072 | 0.022277966 | 0.037338448 |
| 0.29762 | −0.26293 | −0.31023 | −5.703304519 | 0.022355031 | 0.037386861 |
| 0.10261 | −0.089409 | −0.27652 | −5.698517718 | 0.022446256 | 0.037388344 |
| 0.0017658 | 0.045221 | −0.27374 | −5.698202354 | 0.022452279 | 0.037388344 |
| 0.12957 | −0.26947 | −0.37814 | −5.69086361 | 0.022592876 | 0.037541909 |
| 0.37907 | −0.091317 | −0.42356 | −5.676663545 | 0.02286735 | 0.037797657 |
| 0.26414 | −0.067748 | −0.36458 | −5.674684323 | 0.022905862 | 0.037797657 |
| −0.0078654 | −0.15949 | −0.32601 | −5.672573774 | 0.022946999 | 0.037797657 |
| 0.26729 | −0.43553 | −0.36201 | −5.670513674 | 0.022987222 | 0.037797657 |
| 0.15442 | −0.19496 | −0.34538 | −5.669839154 | 0.023000406 | 0.037797657 |
| 0.13934 | −0.14485 | −0.23417 | −5.667510196 | 0.023045985 | 0.037797657 |
| 0.16771 | −0.12133 | −0.3075 | −5.66538039 | 0.023087744 | 0.037797657 |
| −0.032998 | 0.065512 | −0.32834 | −5.65978468 | 0.023197807 | 0.037897891 |
| 0.1253 | −0.1472 | −0.27134 | −5.644988671 | 0.023491287 | 0.038088535 |
| −0.027862 | −0.23172 | −0.32389 | −5.643696445 | 0.023517089 | 0.038088535 |
| −0.066328 | −0.29211 | −0.35428 | −5.642130087 | 0.023548401 | 0.038088535 |
| 0.045576 | 0.0021771 | −0.44403 | −5.642057795 | 0.023549847 | 0.038088535 |
| −0.07068 | 0.30932 | −0.33755 | −5.641483375 | 0.02356134 | 0.038088535 |
| 0.19202 | −0.32853 | −0.34225 | −5.639104276 | 0.023609002 | 0.038088535 |
| 0.24683 | −0.19706 | −0.34703 | −5.628024604 | 0.023832197 | 0.0383423 |
| 0.13169 | 0.1343 | −0.21973 | −5.626398942 | 0.023865117 | 0.0383423 |
| 0.021599 | −0.084624 | −0.34388 | −5.622104478 | 0.023952292 | 0.038372575 |
| 0.083219 | −0.21634 | −0.32084 | −5.61773382 | 0.02404133 | 0.038372575 |
| 0.1732 | −0.16105 | −0.32359 | −5.615967948 | 0.024077395 | 0.038372575 |
| −0.3319 | −0.33608 | −0.4435 | −5.615754511 | 0.024081758 | 0.038372575 |
| 0.12585 | −0.12891 | −0.2767 | −5.60763714 | 0.024248245 | 0.038518667 |
| −0.041339 | −0.22676 | −0.42558 | −5.604537173 | 0.024312119 | 0.038518667 |
| 0.11401 | −0.33418 | −0.38784 | −5.602125395 | 0.024361926 | 0.038518667 |
| −0.00085152 | −0.4539 | −0.357 | −5.601638583 | 0.024371992 | 0.038518667 |
| 0.45495 | 0.14695 | −0.2965 | −5.598998183 | 0.024426655 | 0.038526594 |
| 0.11197 | −0.0052523 | −0.37827 | −5.596085686 | 0.024487089 | 0.038543572 |
| 0.15838 | 0.18827 | −0.25554 | −5.581925552 | 0.024782978 | 0.038839251 |
| 0.22172 | −0.14985 | −0.33273 | −5.579591436 | 0.024832083 | 0.038839251 |
| 0.080379 | −0.081474 | −0.31493 | −5.579038495 | 0.02484373 | 0.038839251 |
| −0.04346 | −0.57853 | −0.39517 | −5.576801858 | 0.024890893 | 0.038839251 |
| 0.1768 | −0.13752 | −0.32606 | −5.574468513 | 0.024940189 | 0.038839251 |
| −0.048564 | 0.004347 | −0.36895 | −5.572812118 | 0.02497524 | 0.038839251 |
| 0.15415 | 0.040987 | −0.39008 | −5.560802847 | 0.025230799 | 0.039158199 |
| 0.066898 | −0.0354 | −0.26089 | −5.554879869 | 0.02535777 | 0.039227007 |
| 0.34653 | 0.13452 | −0.28643 | −5.553941827 | 0.025377936 | 0.039227007 |
| 0.18266 | 0.012557 | −0.37786 | −5.550426885 | 0.025453636 | 0.039227007 |
| 0.36238 | −0.0042651 | −0.31252 | −5.549328617 | 0.025477334 | 0.039227007 |
| 0.3063 | −0.062515 | −0.21289 | −5.542007703 | 0.025635855 | 0.039392708 |
| 0.35177 | −0.013011 | −0.21387 | −5.538014103 | 0.02572272 | 0.039448282 |
| −0.033854 | −0.20116 | −0.23147 | −5.533528448 | 0.025820635 | 0.039453082 |
| −0.020454 | −0.048912 | −0.31343 | −5.532246894 | 0.025848675 | 0.039453082 |
| 0.14871 | −0.51991 | −0.37899 | −5.528714098 | 0.025926126 | 0.039453082 |
| 0.13025 | −0.12065 | −0.20334 | −5.526905876 | 0.025965855 | 0.039453082 |
| 0.029077 | −0.087052 | −0.28796 | −5.522299075 | 0.026067339 | 0.039453082 |
| −0.057152 | −0.21064 | −0.36621 | −5.518031976 | 0.026161681 | 0.039453082 |
| −0.095927 | −0.11393 | −0.42971 | −5.517089707 | 0.026182559 | 0.039453082 |
| 0.24914 | −0.57932 | −0.36956 | −5.514050498 | 0.026250007 | 0.039453082 |
| 0.13007 | −0.046391 | −0.34421 | −5.513623071 | 0.026259506 | 0.039453082 |
| 0.4151 | 0.11804 | −0.339 | −5.51221883 | 0.026290737 | 0.039453082 |
| −0.4569 | −0.21494 | −0.52767 | −5.508667264 | 0.026369887 | 0.039453082 |
| 0.2111 | −0.35001 | −0.30255 | −5.505529973 | 0.026439997 | 0.039453082 |
| 0.19205 | −0.20292 | −0.31909 | −5.505224454 | 0.026446834 | 0.039453082 |
| 0.091946 | −0.1436 | −0.20823 | −5.504834565 | 0.026455561 | 0.039453082 |
| 0.30572 | 0.13964 | −0.27283 | −5.502530827 | 0.026507187 | 0.039453082 |
| −0.12409 | 0.20294 | −0.45492 | −5.501099346 | 0.026539315 | 0.039453082 |
| −0.083227 | −0.18131 | −0.39715 | −5.493914675 | 0.026701137 | 0.039617748 |
| 0.0079925 | −0.041483 | −0.31402 | −5.49113466 | 0.026764007 | 0.039635247 |
| 0.04016 | −0.041706 | −0.26927 | −5.487733701 | 0.026841115 | 0.039673724 |
| −0.097247 | 0.052078 | −0.2508 | −5.482553457 | 0.026958976 | 0.039731689 |
| 0.12419 | −0.00086724 | −0.22557 | −5.481511989 | 0.026982732 | 0.039731689 |
| 0.16135 | −0.084308 | −0.27372 | −5.464035855 | 0.027384394 | 0.040246761 |
| −0.10983 | −0.38282 | −0.41559 | −5.46097685 | 0.027455292 | 0.040253657 |
| −0.46719 | −0.33285 | −0.52856 | −5.459360208 | 0.027492833 | 0.040253657 |
| −0.0020214 | −0.16721 | −0.35695 | −5.4505034 | 0.027699381 | 0.040479698 |
| 0.15978 | 0.042135 | −0.26894 | −5.445917404 | 0.027806918 | 0.040528275 |
| 0.20019 | 0.012274 | −0.27188 | −5.444634394 | 0.027837076 | 0.040528275 |
| −0.19791 | −0.34389 | −0.36227 | −5.440406497 | 0.027936678 | 0.04059712 |
| −0.37382 | −0.13185 | −0.44984 | −5.437511139 | 0.028005086 | 0.040620461 |

TABLE 8-continued

| | | | | | |
|---|---|---|---|---|---|
| 0.038581 | −0.10319 | −0.28217 | −5.431217785 | 0.028154337 | 0.04067272 |
| 0.20334 | −0.18993 | −0.2235 | −5.430087318 | 0.028181228 | 0.04067272 |
| 0.2537 | −0.003958 | −0.24723 | −5.428057619 | 0.028229572 | 0.04067272 |
| 0.023113 | −0.48173 | −0.37071 | −5.42716874 | 0.028250768 | 0.04067272 |
| −0.14152 | −0.012066 | −0.41997 | −5.42075237 | 0.028404234 | 0.040817174 |
| −0.061965 | −0.0088599 | −0.29267 | −5.418582962 | 0.028456303 | 0.040817174 |
| 0.19748 | 0.10572 | −0.33666 | −5.413118295 | 0.028587873 | 0.040930239 |
| −0.052937 | −0.067022 | −0.20596 | −5.404533082 | 0.028795762 | 0.041151955 |
| 0.097495 | −0.31412 | −0.33978 | −5.399358411 | 0.02892177 | 0.041256055 |
| 0.1778 | 0.14641 | −0.26652 | −5.395066935 | 0.029026675 | 0.041329725 |
| 0.052242 | −0.13854 | −0.21706 | −5.391445553 | 0.029115486 | 0.041350998 |
| 0.15844 | −0.39553 | −0.25959 | −5.390114659 | 0.02914819 | 0.041350998 |
| 0.18659 | −0.17716 | −0.28088 | −5.385412771 | 0.029264016 | 0.041439556 |
| −0.070012 | 0.12797 | −0.32447 | −5.383030978 | 0.029322858 | 0.041447246 |
| 0.052055 | −0.09134 | −0.2561 | −5.380771911 | 0.029378774 | 0.04145078 |
| 0.33916 | −0.2285 | −0.37358 | −5.368288944 | 0.02968961 | 0.041813317 |
| 0.098418 | −0.41263 | −0.31484 | −5.354909089 | 0.030026304 | 0.042210617 |
| 0.1546 | −0.20546 | −0.21223 | −5.352459294 | 0.030088349 | 0.042210617 |
| 0.25222 | −0.30092 | −0.26013 | −5.350624487 | 0.030134899 | 0.042210617 |
| 0.21389 | −0.19788 | −0.28408 | −5.34001851 | 0.030405346 | 0.0425127 |
| 0.27985 | −0.15452 | −0.31726 | −5.325519081 | 0.030778866 | 0.042957554 |
| 0.16444 | −0.24985 | −0.27014 | −5.32334062 | 0.030835367 | 0.042959147 |
| 0.13922 | −0.24914 | −0.226 | −5.320411311 | 0.030911499 | 0.042988035 |
| 0.25289 | −0.21189 | −0.23787 | −5.313907127 | 0.031081191 | 0.043108299 |
| −0.078393 | −0.23968 | −0.3441 | −5.31111126 | 0.031154409 | 0.043108299 |
| −0.16252 | −0.6233 | −0.29558 | −5.307845036 | 0.031240157 | 0.043108299 |
| 0.11298 | −0.22885 | −0.34822 | −5.307770346 | 0.03124212 | 0.043108299 |
| 0.22039 | −0.21935 | −0.29887 | −5.306154131 | 0.031284637 | 0.043108299 |
| 0.44533 | −0.46258 | −0.53302 | −5.304383134 | 0.03133129 | 0.043108299 |
| −0.10922 | 0.15736 | −0.25319 | −5.297161417 | 0.031522224 | 0.043294241 |
| −0.35161 | −0.36771 | −0.36839 | −5.291604858 | 0.031669897 | 0.043420212 |
| 0.00034411 | −0.05019 | −0.35425 | −5.281358428 | 0.03194396 | 0.043718718 |
| 0.30472 | −0.48969 | −0.21065 | −5.269199709 | 0.032272139 | 0.043972726 |
| 0.15524 | 0.093103 | −0.33068 | −5.267523655 | 0.032317632 | 0.043972726 |
| −0.015524 | −0.75424 | −0.40554 | −5.266915063 | 0.032334166 | 0.043972726 |
| 0.33995 | −0.20354 | −0.24028 | −5.265523046 | 0.032372015 | 0.043972726 |
| 0.12185 | 0.39418 | −0.29539 | −5.264021637 | 0.032412886 | 0.043972726 |
| 0.28453 | −0.056282 | −0.41677 | −5.259360094 | 0.032540099 | 0.044068267 |
| 0.19392 | −0.16708 | −0.25302 | −5.252170562 | 0.032737245 | 0.044256773 |
| −0.23167 | −0.043898 | −0.34612 | −5.250131912 | 0.032793356 | 0.044256773 |
| 0.036412 | −0.27446 | −0.3164 | −5.2443752 | 0.032952304 | 0.044394076 |
| −0.1516 | −0.13009 | −0.26556 | −5.239889873 | 0.033076661 | 0.044484383 |
| 0.12576 | −0.018307 | −0.2657 | −5.234156959 | 0.033236268 | 0.044621702 |
| −0.085029 | −0.039481 | −0.32001 | −5.228585848 | 0.03339208 | 0.044753461 |
| −0.20484 | −0.96391 | −0.38968 | −5.221524366 | 0.033590587 | 0.044900245 |
| 0.34564 | −0.08393 | −0.33885 | −5.220576356 | 0.033617323 | 0.044900245 |
| 0.25563 | −0.042907 | −0.32124 | −5.212405461 | 0.033848612 | 0.045101997 |
| 0.10026 | −0.03061 | −0.30286 | −5.210120041 | 0.033913578 | 0.045101997 |
| 0.081686 | −0.10738 | −0.24222 | −5.207436334 | 0.033990019 | 0.045101997 |
| 0.2979 | −0.082747 | −0.25416 | −5.207056153 | 0.034000861 | 0.045101997 |
| −0.13166 | −0.57713 | −0.30896 | −5.202284363 | 0.03413723 | 0.045205616 |
| −0.027724 | −0.080681 | −0.23768 | −5.199095992 | 0.034228641 | 0.045236633 |
| 0.12284 | −0.10384 | −0.27674 | −5.196448351 | 0.034304729 | 0.045236633 |
| 0.18506 | −0.082738 | −0.20233 | −5.195377905 | 0.034335537 | 0.045236633 |
| −0.3332 | −0.030903 | −0.39762 | −5.191287959 | 0.034453495 | 0.045315106 |
| −0.036975 | −0.16485 | −0.30019 | −5.180299382 | 0.034772353 | 0.04554834 |
| 0.38079 | −0.11392 | −0.26331 | −5.179254519 | 0.034802819 | 0.04554834 |
| 0.31481 | −0.1875 | −0.22599 | −5.178213559 | 0.034833197 | 0.04554834 |
| 0.1476 | −0.042851 | −0.21052 | −5.173685351 | 0.034965641 | 0.04554834 |
| 0.18396 | −0.025963 | −0.20606 | −5.171603021 | 0.035026709 | 0.04554834 |
| −0.032362 | 0.062923 | −0.24279 | −5.169746193 | 0.03508125 | 0.04554834 |
| 0.070499 | −0.021889 | −0.32259 | −5.168770787 | 0.035109933 | 0.04554834 |
| −0.037335 | −0.070704 | −0.26714 | −5.167530146 | 0.035146449 | 0.04554834 |
| 0.17465 | −0.61669 | −0.32078 | −5.167100873 | 0.035159092 | 0.04554834 |
| 0.15467 | 0.038125 | −0.25274 | −5.162038624 | 0.035308521 | 0.045665687 |
| 0.0089218 | −0.24826 | −0.37265 | −5.157249667 | 0.035450445 | 0.045701135 |
| −0.12654 | −0.13293 | −0.35751 | −5.157139529 | 0.035453716 | 0.045701135 |
| 0.075352 | −0.065464 | −0.23969 | −5.151225517 | 0.035629755 | 0.04585189 |
| −0.014577 | 0.20854 | −0.22732 | −5.147890037 | 0.035729411 | 0.0458669 |
| 0.21919 | −0.21601 | −0.26994 | −5.146880294 | 0.035759632 | 0.0458669 |
| −0.33705 | −0.11639 | −0.39059 | −5.140952417 | 0.0359375 | 0.046019041 |
| 0.44855 | −0.11221 | −0.28385 | −5.12601373 | 0.036389701 | 0.046473806 |
| 0.31522 | 0.052169 | −0.25288 | −5.124397224 | 0.036438955 | 0.046473806 |
| 0.069907 | 0.045763 | −0.2236 | −5.123302223 | 0.036472355 | 0.046473806 |
| 0.21475 | −0.17447 | −0.28625 | −5.113096296 | 0.036785082 | 0.046795449 |
| −0.12987 | −0.19672 | −0.29023 | −5.108971018 | 0.036912218 | 0.046820365 |
| 0.20175 | −0.13538 | −0.23247 | −5.108546048 | 0.036925339 | 0.046820365 |
| 0.20576 | −0.27905 | −0.28816 | −5.103563966 | 0.037079497 | 0.046939135 |
| 0.24636 | −0.24429 | −0.20006 | −5.098548588 | 0.03723531 | 0.04705961 |
| 0.31869 | −0.22136 | −0.21013 | −5.091067217 | 0.037468904 | 0.047277837 |

TABLE 8-continued

| | | | | | |
|---|---|---|---|---|---|
| 0.048512 | −0.10165 | −0.24958 | −5.087703535 | 0.037574389 | 0.04733397 |
| 0.078767 | 0.14053 | −0.29898 | −5.085693477 | 0.03763756 | 0.047336704 |
| −0.33738 | −0.022627 | −0.40997 | −5.081653102 | 0.037764848 | 0.047396046 |
| −0.064771 | −0.062847 | −0.31694 | −5.080321262 | 0.037806897 | 0.047396046 |
| −0.16057 | −0.23504 | −0.29603 | −5.076407462 | 0.037930725 | 0.047474584 |
| 0.19597 | −0.33062 | −0.25436 | −5.072964402 | 0.038039981 | 0.047534662 |
| 0.067129 | −0.15838 | −0.24528 | −5.070482014 | 0.03811894 | 0.047556749 |
| −0.19228 | 0.12076 | −0.36235 | −5.068016686 | 0.038197513 | 0.047578282 |
| 0.2409 | −0.05339 | −0.25129 | −5.059694065 | 0.038463915 | 0.04783333 |
| −0.070565 | −0.24891 | −0.28277 | −5.056955383 | 0.038551968 | 0.047852196 |
| −0.01752 | 0.16331 | −0.30144 | −5.055389046 | 0.038602416 | 0.047852196 |
| 0.10842 | −0.14632 | −0.21577 | −5.051226302 | 0.038736795 | 0.047894744 |
| 0.016974 | 0.094484 | −0.22284 | −5.049751335 | 0.038784517 | 0.047894744 |
| 0.055632 | −0.42812 | −0.28261 | −5.048597131 | 0.0388219 | 0.047894744 |
| 0.17794 | −0.20552 | −0.23853 | −5.040019545 | 0.039100802 | 0.048149384 |
| 0.17551 | 0.10463 | −0.24579 | −5.038439146 | 0.039152399 | 0.048149384 |
| 0.043212 | 0.085444 | −0.22537 | −5.035755544 | 0.039240162 | 0.048180959 |
| 0.092409 | −0.14883 | −0.2495 | −5.030019407 | 0.039428389 | 0.048335593 |
| 0.36545 | −0.50836 | −0.38023 | −5.0266798 | 0.039538375 | 0.048393973 |
| 0.23223 | −0.20035 | −0.25088 | −5.021954539 | 0.039694499 | 0.048508553 |
| −0.15588 | −0.15334 | −0.43233 | −5.015767602 | 0.039899813 | 0.048680943 |
| 0.17784 | −0.17554 | −0.25918 | −5.013928743 | 0.039961032 | 0.048680943 |
| −0.19938 | −0.011302 | −0.26613 | −5.009390669 | 0.040112498 | 0.04878887 |
| 0.024241 | −0.075436 | −0.2477 | −4.999157306 | 0.040456082 | 0.049129764 |
| 0.034912 | −0.20536 | −0.21557 | −4.99174643 | 0.040706662 | 0.049334335 |
| −0.020777 | 0.039638 | −0.29302 | −4.990419497 | 0.040751686 | 0.049334335 |
| 0.22492 | −0.05232 | −0.23262 | −4.986641914 | 0.040880125 | 0.049412737 |
| 0.13374 | 0.0069344 | −0.25318 | −4.982722047 | 0.041013812 | 0.049497229 |
| −0.09917 | 0.11657 | −0.29074 | −4.979472694 | 0.041124949 | 0.049554286 |
| 0.043499 | −0.24342 | −0.28349 | −4.975451432 | 0.041262888 | 0.049556736 |
| 0.23882 | −0.3314 | −0.29704 | −4.973527047 | 0.041329056 | 0.049556736 |
| −0.22488 | −0.17348 | −0.29586 | −4.972667355 | 0.041358648 | 0.049556736 |
| 0.11692 | −0.087367 | −0.24765 | −4.971976931 | 0.041382429 | 0.049556736 |
| −0.13849 | −0.088924 | −0.37173 | −4.965401785 | 0.041609558 | 0.049751952 |

| Gene | sgRNA | ctrl_e2.beta | csk_veh.beta | T47D_w3_E2 | T47D_w4_E2 | score | rank_score | rank_beta | rank_product | final_rank_sc | p | p.select | fdr |
|---|---|---|---|---|---|---|---|---|---|---|---|---|---|
| CHIC2 | 6 | 0.0044514 | -0.70864 | -0.06152 | -0.17441 | -17.716 | 8 | 511 | 8.59E-06 | -11.664895 | 0.00010879 | 0.00010879 | 0.00455136 |
| EPHB2 | 6 | -0.019427 | -0.68158 | -0.048417 | 0.052129 | -17.0395 | 9 | 565 | 1.07E-05 | -11.446656 | 0.00013299 | 0.00013299 | 0.00455136 |
| CRK | 6 | -0.011129 | -0.66435 | -0.074062 | -0.17247 | -16.60875 | 10 | 600.5 | 1.26E-05 | -11.280358 | 0.00015496 | 0.00015496 | 0.00455136 |
| MRS2 | 6 | 0.024246 | -0.65695 | 0.23165 | 0.38281 | -16.42375 | 11 | 612 | 1.41E-05 | -11.166079 | 0.0001721 | 0.0001721 | 0.00455136 |
| VPS53 | 6 | 0.0020874 | -0.65516 | -0.23124 | -0.28708 | -16.379 | 12 | 620 | 1.56E-05 | -11.06608 | 0.00018864 | 0.00018864 | 0.00455136 |
| CYP21A2 | 6 | 0.028615 | -0.62786 | -0.013004 | -0.15454 | -15.6965 | 14 | 682 | 2.01E-05 | -10.816619 | 0.00023708 | 0.00023708 | 0.00455136 |
| PLXDC1 | 6 | -0.010781 | -0.6186 | -0.1488 | -0.09887 | -15.465 | 15 | 695 | 2.19E-05 | -10.728744 | 0.00025693 | 0.00025693 | 0.00455136 |
| PIGB | 6 | -0.015485 | -0.59997 | 0.095824 | 0.32927 | -14.99925 | 19 | 746 | 2.98E-05 | -10.421542 | 0.00034018 | 0.00034018 | 0.00527277 |
| DAO | 6 | -0.018843 | -0.57248 | -0.028973 | 0.32417 | -14.3312 | 21 | 829 | 3.66E-05 | -10.215964 | 0.0004103 | 0.0004103 | 0.00550305 |
| PAK2 | 6 | -0.031596 | -0.55886 | 0.0015692 | 0.046936 | -13.98525 | 23 | 877 | 4.24E-05 | -10.068705 | 0.00046915 | 0.00046915 | 0.00550305 |
| NAGPA | 6 | -0.022465 | -0.55886 | 0.067454 | 0.014327 | -13.9715 | 24 | 878 | 4.43E-05 | -10.025006 | 0.00048817 | 0.00048817 | 0.00550305 |
| HIST3H2BB | 6 | -0.044037 | -0.55527 | 0.11392 | 0.073554 | -12.60917 | 29 | 885 | 5.95E-05 | -9.7293826 | 0.0006385 | 0.0006385 | 0.00627117 |
| UBE2A | 6 | 0.020798 | -0.51117 | 0.025547 | 0.35709 | -12.77925 | 29 | 1079 | 6.58E-05 | -9.6296204 | 0.00069892 | 0.00069892 | 0.00627117 |
| TEAD3 | 6 | -0.02937 | -0.50693 | -0.30785 | -0.26644 | -12.67325 | 30 | 1091 | 6.88E-05 | -9.5846588 | 0.00072797 | 0.00072797 | 0.00627117 |
| TM4SF1 | 6 | 0.01041 | -0.50492 | 0.068168 | 0.15831 | -12.623 | 31 | 1105 | 7.20E-05 | -9.5391184 | 0.00075861 | 0.00075861 | 0.00644227 |
| RBM17 | 6 | -0.010717 | -0.48938 | -0.56757 | -0.71577 | -12.2345 | 33 | 1168 | 8.10E-05 | -9.4211504 | 0.00084404 | 0.00084404 | 0.00644227 |
| GPS2 | 6 | -0.040094 | -0.49435 | 0.065363 | -0.005863 | -12.295082 | 36 | 1152 | 8.71E-05 | -9.3479324 | 0.00090177 | 0.00090177 | 0.00644227 |
| METTL2B | 6 | -0.011896 | -0.47809 | 0.1143 | 0.0081945 | -11.95225 | 38 | 1217 | 9.72E-05 | -9.2389759 | 0.00099499 | 0.00099499 | 0.00644227 |
| VKORC1 | 6 | 0.020337 | -0.47374 | -0.17159 | -0.25283 | -11.8435 | 42 | 1236 | 0.00010908 | -9.1234009 | 0.00110429 | 0.00110429 | 0.00644227 |
| DNAH11 | 6 | -0.035412 | -0.46963 | -0.052074 | 0.0037473 | -11.74075 | 43 | 1255 | 0.0001134 | -9.0846152 | 0.00114357 | 0.00114357 | 0.00644227 |
| XPO4 | 6 | -0.0063698 | -0.46473 | 0.068491 | 0.03266 | -11.61825 | 44 | 1278 | 0.00011816 | -9.0434649 | 0.00118674 | 0.00118674 | 0.00644227 |
| GNPAT | 6 | 0.0021771 | -0.45917 | -0.06553 | -0.050543 | -11.47925 | 46 | 1313 | 0.00012691 | -8.9719949 | 0.00126559 | 0.00126559 | 0.00644227 |
| ALDH6A1 | 6 | -0.02463 | -0.4571 | 0.3112 | 0.4596 | -11.4275 | 47 | 1322 | 0.00013056 | -8.9436575 | 0.00129827 | 0.00129827 | 0.00644227 |
| EEF1G | 6 | -0.0006682 | -0.453 | -0.014841 | 0.10274 | -11.325 | 50 | 1349 | 0.00014173 | -8.8615643 | 0.00139771 | 0.00139771 | 0.00644227 |
| AP2M1 | 6 | 0.007237 | -0.44789 | -0.37067 | -0.34091 | -11.19725 | 52 | 1374 | 0.00015013 | -8.803981 | 0.00147191 | 0.00147191 | 0.00644227 |
| MUSTN1 | 6 | -0.0063698 | -0.44735 | -0.17731 | -0.16789 | -11.18375 | 53 | 1377 | 0.00015336 | -8.7827518 | 0.0015024 | 0.0015024 | 0.00644227 |
| TMEM114 | 6 | 0.0021771 | -0.44403 | -0.22047 | 0.040485 | -11.10075 | 55 | 1394.5 | 0.00016117 | -8.7330818 | 0.00156863 | 0.00156863 | 0.00644227 |
| SNX2 | 6 | -0.0084954 | -0.44249 | 0.16784 | 0.38363 | -11.06225 | 56 | 1405 | 0.00016533 | -8.7056196 | 0.00160496 | 0.00160496 | 0.00644227 |
| C4orf6 | 6 | 0.027377 | -0.43849 | 0.061008 | 0.048176 | -10.96225 | 57 | 1425 | 0.00017068 | -8.6757278 | 0.00165144 | 0.00165144 | 0.00644227 |
| PRPF6 | 6 | 0.017136 | -0.436 | 0.2862 | 0.37886 | -10.9 | 58 | 1435 | 0.00017489 | -8.651343 | 0.00168794 | 0.00168794 | 0.00644227 |
| GABRA4 | 6 | -0.021058 | -0.4351 | 0.108854 | 0.47346 | -10.8775 | 59 | 1438 | 0.00017828 | -8.6321602 | 0.00171721 | 0.00171721 | 0.00644227 |
| IMMP1L | 6 | -0.042049 | -0.4519 | 0.11591 | 0.13352 | -10.746986 | 63 | 1352 | 0.00017898 | -8.6282312 | 0.00172327 | 0.00172327 | 0.00644227 |
| CCBL2 | 6 | 0.03142 | -0.43141 | 0.012516 | 0.29885 | -10.78525 | 61 | 1458 | 0.00018689 | -8.5850114 | 0.00179131 | 0.00179131 | 0.00644227 |
| SEMA3E | 6 | -0.0091037 | -0.42758 | 0.0043055 | 0.033438 | -10.6895 | 64 | 1486 | 0.00019984 | -8.5179799 | 0.0019021 | 0.0019021 | 0.00644227 |
| TMEM114 | 6 | 0.01422 | -0.42698 | 0.3293 | 0.55917 | -10.6745 | 65 | 1488 | 0.00020324 | -8.5011307 | 0.00193099 | 0.00193099 | 0.00644227 |
| SNX2 | 6 | 0.035035 | -0.42472 | 0.089054 | 0.26099 | -10.618 | 66 | 1504 | 0.00020858 | -8.4751679 | 0.00197637 | 0.00197637 | 0.00644227 |
| C4orf6 | 6 | -0.045306 | -0.46174 | -0.074078 | -0.15691 | -10.191586 | 77 | 1296 | 0.00020969 | -8.4698629 | 0.00198577 | 0.00198577 | 0.00644227 |
| DNAH10 | 6 | 0.027534 | -0.42284 | -0.087065 | -0.020381 | -10.571 | 68 | 1518 | 0.00021691 | -8.4360495 | 0.00204673 | 0.00204673 | 0.00644227 |
| STK33 | 6 | -0.0025872 | -0.42145 | -0.00499 | -0.20844 | -10.53625 | 69 | 1531 | 0.00022198 | -8.4129233 | 0.00208948 | 0.00208948 | 0.00644227 |
| PPIL4 | 6 | -0.040884 | -0.42835 | -0.061333 | 0.070159 | -10.477204 | 72 | 1481 | 0.00022407 | -8.4035672 | 0.00210703 | 0.00210703 | 0.00644227 |
| SYNE3 | 6 | -0.012066 | -0.41997 | 0.23018 | -0.16896 | -10.49925 | 70 | 1542 | 0.00022682 | -8.3913754 | 0.00213011 | 0.00213011 | 0.00644227 |
| PIK3R2 | 6 | -0.029475 | -0.41725 | 0.14693 | 0.23072 | -10.43125 | 73 | 1560 | 0.0002393 | -8.3378056 | 0.00223451 | 0.00223451 | 0.00654857 |
| PCDHB15 | 6 | -0.035437 | -0.41667 | 0.029613 | 0.12872 | -10.41675 | 74 | 1567 | 0.00024366 | -8.3197228 | 0.00227088 | 0.00227088 | 0.00654857 |
| ST6GALNAC2 | 6 | -0.022627 | -0.40997 | -0.17039 | -0.0081955 | -10.24925 | 76 | 1607 | 0.00025664 | -8.2678485 | 0.00237847 | 0.00237847 | 0.00670297 |
| RNF121 | 6 | -0.038869 | -0.40483 | -0.26208 | -0.17862 | -10.12075 | 78 | 1637.5 | 0.00026839 | -8.2230714 | 0.00247538 | 0.00247538 | 0.00683412 |
| CD300LF | 6 | 0.040892 | -0.40588 | -0.22263 | -0.4792 | -9.9256578 | 81 | 1629 | 0.00027727 | -8.1905354 | 0.00254822 | 0.00254822 | 0.00683412 |
| DDX10 | 6 | -0.030903 | -0.39762 | -0.036572 | 0.014457 | -9.9405 | 80 | 1680 | 0.00028242 | -8.1721305 | 0.00259035 | 0.00259035 | 0.00683412 |
| XRRA1 | 6 | -0.024238 | -0.3902 | 0.2718 | 0.46049 | -9.755 | 83 | 1726 | 0.00030103 | -8.1083037 | 0.00274186 | 0.00274186 | 0.00698006 |
| EPB41L4A | 6 | -0.036211 | -0.38781 | -0.0084247 | 0.03608 | -9.69525 | 84 | 1740 | 0.00030713 | -8.088249 | 0.00279125 | 0.00279125 | 0.00698006 |
| PLA2G12A | 6 | -0.035407 | -0.38582 | 0.26284 | 0.31065 | -9.6455 | 86 | 1759 | 0.00031787 | -8.0538581 | 0.00287798 | 0.00287798 | 0.00698006 |
| PPP3R1 | | | | | | | | | | | | | |

-continued

| Gene | sgRNA | ctrl_e2.beta | csk_veh.beta | T47D_w3_E2 | T47D_w4_E2 | score | rank_score | rank_beta | rank_product | final_rank_sc | p | p.select | fdr |
|---|---|---|---|---|---|---|---|---|---|---|---|---|---|
| CTR9 | 6 | 0.016816 | −0.38234 | 0.14621 | 0.28146 | −9.5585 | 88 | 1785.5 | 0.00033017 | −8.0159156 | 0.00297675 | 0.00297675 | 0.00698006 |
| CMTM3 | 6 | 0.040987 | −0.39008 | −0.2662 | −0.3539 | −9.517164 | 91 | 1727 | 0.00033024 | −8.0157056 | 0.0029773 | 0.0029773 | 0.00698006 |
| EHMT2 | 6 | 0.0090465 | −0.38201 | −0.026662 | 0.20615 | −9.55025 | 89 | 1789 | 0.00033457 | −8.0026577 | 0.00301204 | 0.00301204 | 0.00698006 |
| LBH | 6 | 0.0071032 | −0.38131 | 0.076272 | 0.1856 | −9.53275 | 90 | 1794 | 0.00033928 | −7.9886935 | 0.00304966 | 0.00304966 | 0.00698006 |
| COLEC10 | 6 | −0.0090627 | −0.38016 | −0.080758 | 0.10582 | −9.504 | 94 | 1803 | 0.00035613 | −7.9402042 | 0.00318391 | 0.00318391 | 0.00698006 |
| GTF2A1L | 6 | −0.0053523 | −0.37827 | 0.21963 | 0.51218 | −9.45675 | 96 | 1820 | 0.00036714 | −7.9097662 | 0.00327114 | 0.00327114 | 0.00698006 |
| TMEM233 | 6 | 0.046944 | −0.42386 | 0.031119 | −0.12134 | −9.0290559 | 116 | 1511 | 0.00036831 | −7.906589 | 0.00328037 | 0.00328037 | 0.00698006 |
| PI4K2A | 6 | 0.012557 | −0.37786 | −0.37471 | −0.19866 | −9.4465 | 97 | 1824 | 0.00037178 | −7.897208 | 0.0033078 | 0.0033078 | 0.00698006 |
| CACNG1 | 6 | −0.0051792 | −0.37764 | −0.24655 | −0.15828 | −9.441 | 99 | 1825 | 0.00037965 | −7.8762511 | 0.0033699 | 0.0033699 | 0.00698006 |
| TARBP1 | 6 | −0.020804 | −0.37687 | 0.073614 | 0.35371 | −9.42175 | 100 | 1830.5 | 0.00038464 | −7.8631916 | 0.00340918 | 0.00340918 | 0.00698006 |
| LSM6 | 6 | 0.028243 | −0.37561 | 0.019558 | 0.040932 | −9.39025 | 102 | 1845 | 0.00039545 | −7.8354988 | 0.00349395 | 0.00349395 | 0.00698006 |
| QRFP | 6 | −0.043509 | −0.39413 | −0.25049 | −0.078165 | −9.0585856 | 112 | 1699.5 | 0.00039997 | −7.8241179 | 0.00352939 | 0.00352939 | 0.00698006 |
| BST2 | 6 | 0.036137 | −0.37405 | 0.092164 | 0.14439 | −9.35125 | 103 | 1858 | 0.00040214 | −7.8187213 | 0.00354632 | 0.00354632 | 0.00698006 |
| UBE2S | 6 | −0.036975 | −0.37159 | −0.17266 | −0.42997 | −9.28975 | 104 | 1878 | 0.00041041 | −7.7983526 | 0.00361094 | 0.00361094 | 0.00699619 |
| STRA13 | 6 | 0.004347 | −0.36895 | 0.16333 | −0.23236 | −9.22375 | 106 | 1899 | 0.00042298 | −7.7681844 | 0.00370877 | 0.00370877 | 0.00706224 |
| CENPE | 6 | −0.016265 | −0.36836 | −0.18103 | −0.43972 | −9.209 | 107 | 1910 | 0.00042944 | −7.7530188 | 0.00375893 | 0.00375893 | 0.00706224 |
| HPGDS | 6 | −0.03511 | −0.36474 | 0.28728 | 0.4597 | −9.1185 | 109 | 1942 | 0.0004448 | −7.7178846 | 0.00387772 | 0.00387772 | 0.00717668 |
| KTI12 | 6 | 0.014973 | −0.36139 | −0.39054 | −0.82474 | −9.03475 | 115 | 1972 | 0.00047653 | −7.6489705 | 0.00412153 | 0.00412153 | 0.00749594 |
| C5 | 6 | −0.030457 | −0.36097 | 0.089047 | 0.43395 | −9.02425 | 117 | 1976 | 0.00048581 | −7.6297024 | 0.00419236 | 0.00419236 | 0.00749594 |
| PSG6 | 6 | 0.017388 | −0.36059 | 0.016982 | −0.011883 | −9.01475 | 118 | 1980 | 0.00049095 | −7.6191694 | 0.00423158 | 0.00423158 | 0.00749594 |
| CHRNA1 | 6 | −0.024177 | −0.35715 | −0.071217 | −0.13475 | −8.92875 | 122 | 2010 | 0.00051528 | −7.5707951 | 0.00441638 | 0.00441638 | 0.0076404 |
| TDP1 | 6 | −0.022006 | −0.35605 | 0.186656 | 0.21631 | −8.90125 | 123 | 2017 | 0.00052132 | −7.5591553 | 0.00446202 | 0.00446202 | 0.0076404 |
| FAHD2B | 6 | −0.0048606 | −0.35544 | 0.035446 | −0.067927 | −8.886 | 124 | 2019 | 0.00052607 | −7.550067 | 0.00449798 | 0.00449798 | 0.0076404 |
| GCC2 | 6 | −0.029261 | −0.3531 | 0.37881 | 0.68831 | −8.8275 | 125 | 2037 | 0.00053505 | −7.533159 | 0.00456563 | 0.00456563 | 0.00765051 |
| SPATA5L1 | 6 | 0.010642 | −0.34917 | −0.12848 | −0.20411 | −8.72925 | 129 | 2071 | 0.00056138 | −7.4851069 | 0.0047634 | 0.0047634 | 0.00787548 |
| WASF2 | 6 | −0.024618 | −0.34672 | −0.4797 | −0.91921 | −8.668 | 131 | 2090 | 0.00057532 | −7.4605895 | 0.00486752 | 0.00486752 | 0.00794174 |
| HOOK1 | 6 | −0.023957 | −0.34169 | 0.4022 | 0.66509 | −8.54225 | 133 | 2139 | 0.00059779 | −7.4222633 | 0.00503478 | 0.00503478 | 0.00809603 |
| EIF4G1 | 6 | 0.0069398 | −0.33993 | 0.12093 | 0.15081 | −8.49825 | 135 | 2151 | 0.00061019 | −7.4017433 | 0.00512664 | 0.00512664 | 0.00809603 |
| LINGO4 | 6 | 0.0022093 | −0.33987 | −0.30772 | −0.36123 | −8.49675 | 136 | 2153 | 0.00061528 | −7.3934338 | 0.00516431 | 0.00516431 | 0.00809603 |
| KLRF1 | 6 | −0.015572 | −0.3382 | −0.024856 | −0.10134 | −8.468 | 137 | 2165 | 0.00062326 | −7.3380496 | 0.00522325 | 0.00522325 | 0.00809603 |
| XPO7 | 6 | −0.029598 | −0.33595 | 0.078395 | −0.061064 | −8.39875 | 139 | 2191.5 | 0.0006401 | −7.3358907 | 0.0053473 | 0.0053473 | 0.00811233 |
| CCDC74A | 5 | 0.043581 | −0.35252 | −0.19445 | −0.29763 | −8.0888461 | 150 | 2043 | 0.00064395 | −7.3478963 | 0.00537559 | 0.00537559 | 0.00811233 |
| COPS3 | 6 | 0.045402 | −0.36152 | −0.17135 | −0.24086 | −7.9626448 | 160 | 1969 | 0.000662 | −7.3202513 | 0.00550797 | 0.00550797 | 0.00811233 |
| ANKRD28 | 6 | −0.043134 | −0.34701 | 0.11278 | 0.13889 | −8.0449298 | 155 | 2086 | 0.00067942 | −7.2942774 | 0.00563526 | 0.00563526 | 0.00811233 |
| ZDHHC4 | 6 | −0.013813 | −0.33013 | 0.186656 | 0.015905 | −8.25325 | 145 | 2232 | 0.00068007 | −7.2933191 | 0.00564001 | 0.00564001 | 0.00811233 |
| SPICE1 | 6 | 0.0055685 | −0.32952 | 0.15785 | 0.26623 | −8.238 | 146 | 2235 | 0.00068568 | −7.285103 | 0.00568091 | 0.00568091 | 0.00811233 |
| SPATA6 | 6 | −0.045423 | −0.35893 | −0.064143 | 0.12977 | −7.7901439 | 164 | 1994 | 0.00068716 | −7.2829418 | 0.00569172 | 0.00569172 | 0.00811233 |
| GPHB5 | 6 | 0.0068676 | −0.32679 | −0.15968 | −0.075574 | −8.16975 | 147 | 2258 | 0.00069748 | −7.2680388 | 0.00576678 | 0.00576678 | 0.00812592 |
| TRMT12 | 6 | 0.013306 | −0.3256 | 0.21898 | 0.38533 | −8.14 | 149 | 2272 | 0.00071135 | −7.248344 | 0.00586747 | 0.00586747 | 0.00815489 |
| TEAD2 | 6 | −0.043898 | −0.34612 | 0.41583 | 0.26854 | −7.8846417 | 167 | 2095 | 0.00073517 | −7.2154035 | 0.00603975 | 0.00603975 | 0.00815489 |
| NAPB | 6 | −0.037188 | −0.32267 | 0.14962 | 0.21379 | −8.06675 | 152 | 2304 | 0.00073589 | −7.2144236 | 0.00604495 | 0.00604495 | 0.00815489 |
| COMMD1 | 6 | −0.021889 | −0.32259 | −0.0727 | −0.071962 | −8.06475 | 153 | 2306 | 0.00074138 | −7.2069985 | 0.0060845 | 0.0060845 | 0.00815489 |
| TM2D2 | 6 | −0.017847 | −0.32199 | −0.10624 | −0.19458 | −8.04975 | 154 | 2309.5 | 0.00074736 | −7.1989672 | 0.00612756 | 0.00612756 | 0.00815489 |
| ENY2 | 6 | 0.01542 | −0.32171 | 0.15768 | 0.11479 | −8.04275 | 156 | 2313 | 0.00075821 | −7.1845495 | 0.00620561 | 0.00620561 | 0.00815489 |
| BRCA1 | 6 | −0.02206 | −0.32037 | −0.0038713 | −0.049816 | −8.009255 | 157 | 2327 | 0.00076769 | −7.1721252 | 0.00627365 | 0.00627365 | 0.00815489 |
| KANK4 | 6 | −0.039481 | −0.33001 | 0.10474 | 0.28969 | −8.00025 | 158 | 2329 | 0.00077324 | −7.1649169 | 0.00631347 | 0.00631347 | 0.00815489 |
| GID8 | 6 | −0.040583 | −0.32179 | −0.2722 | −0.272 | −7.9291822 | 163 | 2312 | 0.00079189 | −7.1410877 | 0.00644685 | 0.00644685 | 0.00817135 |
| UPRT | 6 | 0.027379 | −0.31841 | 0.20242 | 0.41142 | −7.96025 | 161 | 2352 | 0.00079571 | −7.1362805 | 0.00647409 | 0.00647409 | 0.00817135 |
| VEZT | 6 | 0.028254 | −0.31758 | −0.010856 | −0.17553 | −7.9395 | 162 | 2358 | 0.00080269 | −7.1275408 | 0.0065239 | 0.0065239 | 0.00817135 |
| GRIN1 | 6 | −0.041827 | −0.32418 | 0.10913 | 0.0084344 | −7.7504961 | 172 | 2292 | 0.00082839 | −7.0960316 | 0.00670664 | 0.00670664 | 0.00831623 |
| ARV1 | 6 | −0.0042651 | −0.31252 | −0.074098 | −0.22956 | −7.813 | 170 | 2395 | 0.00085555 | −7.0637692 | 0.00689894 | 0.00689894 | 0.00835439 |

-continued

| Gene | sgRNA | ctrl_e2.beta | csk_veh.beta | T47D_w3_E2 | T47D_w4_E2 | score | rank_score | rank_beta | rank_product | final_rank_sc | p | p.select | fdr |
|---|---|---|---|---|---|---|---|---|---|---|---|---|---|
| PRKAA2 | 6 | -0.039528 | -0.30974 | 0.1723 | 0.17425 | -7.7435 | 173 | 2414 | 0.00087755 | -7.0383742 | 0.00705409 | 0.00705409 | 0.00835439 |
| FAM134C | 6 | 0.02912 | -0.30962 | -0.23023 | -0.44254 | -7.7405 | 174 | 2416 | 0.00088336 | -7.0317823 | 0.00709492 | 0.00709492 | 0.00835439 |
| RAB17 | 6 | 0.030915 | -0.30789 | -0.019532 | 0.18955 | -7.69725 | 175 | 2432 | 0.00039432 | -7.019451 | 0.00717193 | 0.00717193 | 0.00835439 |
| TET3 | 6 | 0.027091 | -0.30778 | 0.06628 | 0.16088 | -7.6945 | 176 | 2434 | 0.00090017 | -7.0129309 | 0.00721297 | 0.00721297 | 0.00835439 |
| AMPD3 | 6 | -0.046391 | -0.34421 | 0.12007 | 0.24565 | -7.4197581 | 204 | 2116 | 0.00090706 | -7.0053034 | 0.00726128 | 0.00726128 | 0.00835439 |
| PKIG | 6 | -0.045783 | -0.34083 | -0.14546 | -0.27565 | -7.4444663 | 202 | 2143 | 0.00090963 | -7.0024765 | 0.00727926 | 0.00727926 | 0.00835439 |
| EIF4A3 | 6 | -0.027742 | -0.30674 | -0.077002 | -0.25809 | -7.6685 | 178 | 2454 | 0.00091788 | -6.993448 | 0.007337 | 0.007337 | 0.00835439 |
| WLS | 6 | -0.041483 | -0.31402 | 0.3945 | 0.35485 | -7.5698479 | 184 | 2383 | 0.00092136 | -6.9896549 | 0.00736138 | 0.00736138 | 0.00835439 |
| POLE2 | 6 | -0.0038945 | -0.30635 | -0.23648 | -0.53904 | -7.65875 | 180 | 2459 | 0.00093008 | -6.9802393 | 0.00742227 | 0.00742227 | 0.00835439 |
| FAM177B | 6 | -0.013069 | -0.30403 | 0.27365 | 0.38314 | -7.60075 | 182 | 2481.5 | 0.00094902 | -6.960081 | 0.00755427 | 0.00755427 | 0.00835439 |
| METTL20 | 6 | -0.042907 | -0.32124 | 0.034429 | 0.33033 | -7.4868903 | 196 | 2317 | 0.00095427 | -6.954563 | 0.00759081 | 0.00759081 | 0.00835439 |
| NDFIP1 | 6 | -0.03061 | -0.30286 | -0.12042 | -0.20981 | -7.5715 | 183 | 2490 | 0.0009575 | -6.951182 | 0.00761328 | 0.00761328 | 0.00835439 |
| ZIM3 | 6 | -0.019341 | -0.30236 | -0.047469 | 0.14383 | -7.559 | 186 | 2497 | 0.00097594 | -6.9321142 | 0.00774123 | 0.00774123 | 0.00842029 |
| PROSER1 | 6 | -0.030269 | -0.30192 | 0.30643 | 0.44768 | -7.548 | 189 | 2502.5 | 0.00099386 | -6.9139136 | 0.00786533 | 0.00786533 | 0.00848087 |
| SPATA31C2 | 6 | -0.044439 | -0.32183 | 0.13692 | 0.29302 | -7.2420622 | 219 | 2311 | 0.00106349 | -6.8461988 | 0.00834436 | 0.00834436 | 0.00891983 |
| REG3A | 6 | -0.043533 | -0.31623 | -0.073312 | -0.060032 | -7.2641444 | 216 | 2371 | 0.00107616 | -6.8343607 | 0.00843099 | 0.00843099 | 0.0089541 |
| GNB1L | 6 | 0.048158 | -0.33608 | -0.38898 | -0.74772 | -6.9786951 | 240 | 2189 | 0.00110394 | -5.8088672 | 0.00862054 | 0.00862054 | 0.00905888 |
| BAK1 | 6 | -0.047594 | -0.32844 | 0.083158 | 0.33463 | -6.9008699 | 245 | 2242 | 0.00115423 | -6.7643244 | 0.00896179 | 0.00896179 | 0.00933834 |
| ACADSB | 6 | -0.042533 | -0.30194 | 0.1514 | 0.10675 | -7.0989585 | 228 | 2501 | 0.00119822 | -6.7569146 | 0.00925858 | 0.00925858 | 0.0095672 |
| CACNA1C | 6 | -0.043846 | -0.30111 | 0.053367 | 0.19751 | -6.8674451 | 247 | 2518 | 0.0013069 | -6.6400976 | 0.00998484 | 0.00998484 | 0.0102324 |
| DIAPH3 | 6 | -0.045647 | -0.30125 | -0.019884 | -0.081604 | -6.5995575 | 274 | 2516 | 0.00144861 | -6.5371524 | 0.01091838 | 0.01091838 | 0.01109164 |
| RNF145 | 6 | -0.048912 | -0.31343 | 0.2415 | 0.26676 | -6.4080389 | 291 | 2390 | 0.00146144 | -6.5283343 | 0.0110022 | 0.0110022 | 0.01109164 |
| FAM69A | 6 | 0.047355 | -0.30284 | -0.058475 | -0.011358 | -6.3951008 | 296 | 2491.5 | 0.00154968 | -6.4697065 | 0.01157566 | 0.01157566 | 0.01157566 |

SEQUENCE LISTING (329 sequences)

SEQ ID NO: 1 - DNA, 1353 bp, Homo sapiens
atgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtga

SEQ ID NO: 2 - DNA, 1353 bp, Homo sapiens; identical to SEQ ID NO: 1

SEQ ID NO: 3 - DNA, 1353 bp, Homo sapiens; identical to SEQ ID NO: 1

SEQ ID NO: 4 - DNA, 1353 bp, Homo sapiens; identical to SEQ ID NO: 1

SEQ ID NO: 5 - protein, 450 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 6 - protein, 450 aa, Homo sapiens; identical to SEQ ID NO: 5

SEQ ID NO: 7 - protein, 450 aa, Homo sapiens; identical to SEQ ID NO: 5

SEQ ID NO: 8 - protein, 450 aa, Homo sapiens; identical to SEQ ID NO: 5

SEQ ID NO: 9 - DNA, 1353 bp, Mus musculus
atgtcggcaatacaggccgcctggccatccggtacagaatgtattgccaagtacaacttccatggcactgctgagcaagaccttcccttctgcaaaggagatgtgctcaccatcgtggctgtcaccaaggaccccaactggtacaaagccaaaaacaaagtgggccgtgagggcatcatcccagccaactatgtccagaagcgtgagggtgtgaaggcaggcaccaaactcagccttatgccctggttccacggcaagatcacacgggagcaggccgagcggcttctttacccaccagagacaggcctgttcctcgtgcgggaaagcaccaactaccctggagactacacactgtgtgtgagctgtgagggcaaggtggagcactaccgcatcatgtatcatgcgagcaagctgagcattgatgaggaggtgtactttgagaacctcatgcagctggtggagcactacaccacagatgccgatggactctgcactcgcctcatcaaaccaaaggtcatggagggcaccgtggcggcccaggatgagttctaccgcagtggctgggcactgaacatgaaggaactgaagctgctacagacaatagggaagggggagtttggagatgtgatgctgggggattaccggggcaacaaagttgcagtcaagtgcatcaagaatgacgcaactgcccaggccttcctggctgaagcctccgtcatgacgcaacttcggcacagcaacctcgtccagctgctgggtgtgattgtggaggagaagggtgggctctacatcgtcacagagtacatggccaaggggagtttggtggactatcttcgatcacgtggtcgttcggtgctaggtggagactgtctcctcaaattctcattagacgtctgtgaagccatggagtacctggagggtaacaattttgtgcaccgggacttggctgcccggaatgtgctggtgtctgaagacaacgtggccaaagtcagtgactttggcctcactaaggaagcctccagcactcaggacacaggcaagctgccagtcaaatggacagcgcctgaagccttgagagagaagaaattttccaccaagtctgatgtgtggagtttcggaatccttctctgggaaatctattccttcgggcgagtgccttacccaagaattcccctgaaggacgtcgtccctcgggtggaaaagggctataagatggacgctccggatggctgcccgcccgcagtctacgaggtgatgaagaactgctggcacctggatgctgccacacggcccacgtttttgcagcttcgggaacagctcgagcacatcaagacccatgagctgcacctgtga

SEQ ID NO: 10 - DNA, 1353 bp, Mus musculus; identical to SEQ ID NO: 9

SEQ ID NO: 11 - DNA, 1353 bp, Mus musculus; identical to SEQ ID NO: 9

SEQ ID NO: 12 - DNA, 1353 bp, Mus musculus; identical to SEQ ID NO: 9

SEQ ID NO: 13 - DNA, 723 bp, Mus musculus
atgtcggcaatacaggccgcctggccatccggtacagaatgtattgccaagtacaacttccatggcactgctgagcaagaccttcccttctgcaaaggagatgtgctcaccatcgtggctgtcaccaaggaccccaactggtacaaagccaaaaacaaagtgggccgtgagggcatcatcccagccaactatgtccagaagcgtgagggtgtgaaggcaggcaccaaactcagccttatgccctggttccacggcaagatcacacgggagcaggccgagcggcttctttacccaccagagacaggcctgttcctcgtgcgggaaagcaccaactaccctggagactacacactgtgtgtgagctgtgagggcaaggtggagcactaccgcatcatgtatcatgcgagcaagctgagcattgatgaggaggtgtactttgagaacctcatgcagctggtggagatcaggacacaaaggttcggatcagcgaagatcccctcgtctacgcattggaggtgtctgtctgatccagacctcacttcctccagcactcagaacctcatgtcgggatgtgtacattgccgtcaaggtcctggaggcaggcacacaggtccttgctgcttccaacaccggctccacccgttccagccaggccatatctggcatcaaagacccataggttcctctgagctcactctcatctctggcccgccctgtccctga

SEQ ID NO: 14 - protein, 450 aa, Mus musculus
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCEGKVEHYRIMYHASKLSIDEEVYFENLMQLVEHYTTDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAATRPTFLQLREQLEHIKTHELHL

SEQ ID NO: 15 - protein, 450 aa, Mus musculus; identical to SEQ ID NO: 14

SEQ ID NO: 16 - protein, 450 aa, Mus musculus; identical to SEQ ID NO: 14

SEQ ID NO: 17 - protein, 450 aa, Mus musculus; identical to SEQ ID NO: 14

SEQ ID NO: 18 - protein, 240 aa, Mus musculus
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCEGKVEHYRIMYHASKLSIDEEVYFENLMQLVEIRTQRFGSAKIPSSTHWRCLSDPDLTSSSTQNLMSGCVHCRQGPGGRHTGPCCFQHRLHPFQPGHIWHQRPIGSSELTLISGPPCP

SEQ ID NO: 19 - DNA, 1353 bp, Pan troglodytes
atgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgctgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagcctcgtggactacctgcggtctcggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaggtcatgaagaactgctggcacctggacgccgccatgcggccctccttcctacagctccgagagcagcttgagcacatcaaaacccacgagctgcacctgtga

SEQ ID NO: 20 - protein, 450 aa, Pan troglodytes; identical to SEQ ID NO: 5

SEQ ID NO: 21 - DNA, 1353 bp, Macaca mulatta
atgtcagcaatacaggcctcctggccatccggtacagaatgtattgccaagtacaacttccacggcaccgccgagcaagacctgcctttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccctggggactacacgctgtgcgtgagctgcgatggcaaggtggagcactaccgcatcatgtaccatgccagcaagctcagcatcgacgaggaggtgtactttgagaatctcatgcagctggtggagcactacacctcagacgcagatggactctgtacgcgcctcattaaaccaaaggtcatggagggcacggtggcggcccaggatgagttctaccgcagtggctgggccctgaacatgaaggagctgaagctactgcagaccattgggaagggggagttcggagacgtgatgctgggcgattaccgagggaacaaagtcgctgtcaagtgcattaagaacgacgccaccgcccaggccttcctggctgaagcttcagtcatgacgcaactgcggcatagcaacctggtgcagctcctgggcgtgatcgtggaggagaagggcgggctctacatcgtcactgagtacatggccaaggggagcctcgtggactacctgcggtctcggggtcggtcagtgctgggcggagactgtctcctcaagttctcgctagatgtctgcgaggccatggaatacctggagggcaacaacttcgtgcatcgagacctggctgcccgcaacgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgatggctgcccgcccgcagtctatgaggtcatgaagaactgctggcacctggacgccgccatgcggccatccttcctacagctccgagagcagcttgagcacatcaaaacccatgagctgcacctgtga

SEQ ID NO: 22 - protein, 450 aa, Macaca mulatta
MSAIQASWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 23 - DNA, 1353 bp, Canis familiaris
atgtcagcaatccaggccgcctggccatccggtacagaatgtattgccaagtacaatttccatggcactgccgagcaggaccttcccttctgcaaaggagacgtgctcaccattgtggcggtcaccaaggacccaaactggtacaaagccaagaacaaggtgggccgtgagggcatcatcccagccaactacgtccagaaacgggagggcgtgaaggccggcaccaagctcagcctcatgccctggttccatggcaagatcacgcgggagcaggccgagcggctgctgtgcccgcccgagaccggcctgttcctggtgcgggagagcaccaactacccgggggactacacgctgtgcgtgagctgtgacggcaaggtggagcactaccgcatcatgtaccacgccagcaagctcagcatcgacgaggaggtgtacttcgagaacctcatgcagctggtggagcactacacctcggacgcggacggactctgtactcgcctcatcaagccaaaggtcatggagggcacggtggccgcccaggatgagttcttccgcagcggctgggcactgaacatgaaggacctgaagctgctgcagaccattgggaagggggagtttggagacgtgatgctaggcgattaccgagggaacaaggttgctgtcaagtgcattaaaaatgacgccactgcccaggcctttctggctgaagcctctgtgatgacgcaacttcggcatagcaacctggtacagcttctgggtgtgatcgtggaagagaagggcgggctgtacattgtcacggagtacatggccaagggaagcctggtggactatctgcggtcaaggggtcgatcggtgctgggcggagactgtctcctcaagttctcactagatgtctgtgaggccatggaatacctggagggcaacaacttcgtgcaccgggatctggctgcccgcaacgtgctggtgtctgaagacaacgtggccaaggtcagcgactttggcctcaccaaggaggcctccagcacccaggacacgggcaagctgccagtcaagtggacggccccggaggccctgagagagaagaaattctccaccaagtctgacgtgtggagtttcggaatccttctctgggaaatctactcctttgggcgagtgccttacccaagaattcccctgaaggacgtcgtccctcgggtggagaagggctacaagatggacgcccccgacggctgcccacctgcggtctacgaggtcatgaagaactgctggcacctggatgctgccacaaggccctccttcctgcagctccgggagcagctcgagcacatcaaaacccacgagttgcacctgtga

SEQ ID NO: 24 - DNA, 1353 bp, Canis familiaris; identical to SEQ ID NO: 23

SEQ ID NO: 25 - DNA, 1353 bp, Canis familiaris; identical to SEQ ID NO: 23

SEQ ID NO: 26 - protein, 450 aa, Canis familiaris
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLCPPETGLFLVRESTNYPGDYTLCVSCDGKVEHYRIMYHASKLSIDEEVYFENLMQLVEHYTSDADGLCTRLIKPKVMEGTVAAQDEFFRSGWALNMKDLKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAATRPSFLQLREQLEHIKTHELHL

SEQ ID NO: 27 - protein, 450 aa, Canis familiaris; identical to SEQ ID NO: 26

SEQ ID NO: 28 - protein, 450 aa, Canis familiaris; identical to SEQ ID NO: 26

SEQ ID NO: 29 - DNA, 1353 bp, Bos taurus
atgtcagcaattcaggctgcctggccatccggtacagaatgtattgccaagtacaactttcacggcactgctgagcaagaccttcccttctgcaaaggagatgtgctcaccattgtggctgtcaccaaggaccccaattggtacaaagccaagaacaaggtgggccgtgagggcatcatcccagccaactatgtccagaagcgggagggtgtgaaggcaggcaccaagctcagcctcatgccctggttccatggcaagatcacgcgggaacaggcagagcggctcctgtgcccaccggagacaggcctgttcctggtgcgggagagcaccaactaccccggggactacacgctgtgcgtgagctgtgatggcaaggtggagcattaccgcatcatgtaccacgccagcaagctcagcatcgatgaagaggtgtactttgagaacctcatgcagctggtggagcactacacctcagatgcagatggcctctgtactcgcctcatcaagccaaaggtcatggagggcaccgtggccgcccaggatgagttcttccgcagtggctgggcgctgaacatgaaggacctgaagctgctgcagaccatagggaagggggagtttggagacgtgatgctgggtgactaccgagggaacaaagtcgctgtcaagtgcattaagaacgatgccactgcacaggccttcctggctgaagcctccgtcatgacgcaactccggcatagcaacctggtacagcttctgggcgtgatcgtagaggagaagagcgggctgtacatcgttaccgagtacatggccaaggggagtctagtggactacctgcggtctcggggtcggtcggtgcttggcggagactgtctcctcaagttctcactagacgtctgtgaggccatggaatacctggagggcaacaacttcgtgcatcgggatctggctgcccgcaacgtgctggtgtctgaggacaatgtggccaaggtcagcgacttcggcctcaccaaggaggcctccagcacccaggacacgggcaagctgccggtcaagtggacagcccccgaggccctaagagagaagaaattctccaccaagtctgatgtgtggagtttcgggatccttctctgggaaatctactctttcgggcgagtgccttatccaagaattcccctgaaggacgtcgtcccgcgggtggagaagggctacaagatggatgcccctgacggctgcccacctgcagtctacgaggtcatgaagaactgctggcacctggatgccgccacgcggccctccttcctgcagctccgcgagcagctcgagcgcatcaagacccacgagctgcacctgtga

SEQ ID NO: 30 - protein, 450 aa, Bos taurus
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLCPPETGLFLVRESTNYPGDYTLCVSCDGKVEHYRIMYHASKLSIDEEVYFENLMQLVEHYTSDADGLCTRLIKPKVMEGTVAAQDEFFRSGWALNMKDLKLLQTIGKGEFGDVMLGDYRGNKVAVKCIKNDATAQAFLAEASVMTQLRHSNLVQLLGVIVEEKSGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAATRPSFLQLREQLERIKTHELHL

SEQ ID NO: 31 - DNA, 1353 bp, Rattus norvegicus
atgtcggctatacaggcctcctggccatccggtacagaatgtattgccaagtacaacttccatggcactgccgagcaagaccttcccttctgcaaaggagatgtgctcaccattgtggctgtcaccaaggaccccaactggtacaaagccaaaaacaaagtgggccgtgagggcatcatcccagccaactatgtccagaagcgtgagggtgtgaaggcaggcaccaagctcagccttatgccctggttccacggcaagatcacacgggagcaggcggagcggcttctctacccaccagagacaggcctgttcctggtgcgggaaagcaccaactaccctggggactacacactgtgtgtgagctgtgaaggcaaggtggagcactaccgcatcatgtatcacgcgagcaagctgagcattgatgaggaggtgtacttcgagaacctcatgcagctggtggagcactacaccacagatgccgacggactctgcactcgcctcatcaaaccaaaggtcatggagggcacagtggcggcccaagatgaattctaccgcagtggctgggccctgaacatgaaggaactgaagctgctacagacgataggaaagggggagtttggagatgtgatgctgggggattaccgaggcaacaaagttgcagtcaagtgcattaagaatgatgctacagcccaggccttcctggctgaagcctctgtcatgacgcagcttcggcacagcaacctagtccagctactgggtgtgattgtggaggagaagggtgggctctacatcgtcacagagtacatggccaaggggagtttggtggactatcttcgatcacgtggtcgttcggtgctaggcggagactgtctcctcaaattctcactagacgtctgtgaagccatggagtacctggagggtaacaattttgtgcaccgggacttggctgcccggaatgtgctggtgtctgaggacaacgtggccaaagtcagtgactttggcctcactaaggaagcttccagcactcaggacacaggcaaactgccagtcaagtggacagctcctgaagccttgagagagaagaaattttccaccaagtctgatgtgtggagtttcggaatccttctctgggaaatctattccttcgggcgagtgccttacccaagaattcccctgaaggacgtcgtccctcgggtggaaaagggctataagatggacgctccggatggctgcccacccgcagtctatgatgttatgaagaactgctggcacctggatgctgccacgcggcccacctttctgcagcttcgagagcagctcgagcacatcagaacccatgagctgcacctgtga

SEQ ID NO: 32 - DNA, 1353 bp, Rattus norvegicus; identical to SEQ ID NO: 31

SEQ ID NO: 33 - DNA, 1353 bp, Rattus norvegicus; identical to SEQ ID NO: 31

SEQ ID NO: 34 - protein, 450 aa, Rattus norvegicus
MSAIQASWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCEGKVEHYRIMYHASKLSIDEEVYFENLMQLVEHYTTDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYDVMKNCWHLDAATRPTFLQLREQLEHIRTHELHL

SEQ ID NO: 35 - protein, 450 aa, Rattus norvegicus; identical to SEQ ID NO: 34

SEQ ID NO: 36 - protein, 450 aa, Rattus norvegicus; identical to SEQ ID NO: 34

SEQ ID NO: 37 - DNA, 1353 bp, Gallus gallus
atgtcagggatgcaggccgtttggccatccggtacagaatgtatcgccaagtacaacttccacggtacggccgagcaggacctgccgttcagcaagggagacgtcctcaccatcgtcgccgtcaccaaggaccccaactggtacaaggcgaagaacaaggtgggccgggagggcatcatccccgctaactacgtgcagaagagggaaggagtgaaggctggcatcaagctcagcctcatgccgtggttccatgggaagatcacacgggagcaggcagagaggctgctgtacccacccgagacggggctgttcctggtgcgggagagcaccaactaccccggggactacaccctgtgtgtgagctgtgagggcaaggtggagcactaccgcatcatttactcctccagcaagctgagcatcgacgaggaggtctacttcgagaacctgatgcagcttgtggagcattacaccacggacgccgacggcctctgctcgcgcctcatcaaaccgaaggtgatggaggggacggtggcagctcaggatgagttctcccgcagtggctgggccctcaacatgaaggacctcaagctgctgcaaatcattggcaaaggggaatttggagatgtgatgctgggtgattaccgggggaacaaagtcgccgtcaagtgcattaaaaatgacgccacagcgcaggctttcctggcagaagcgtccgtgatgacgcagctccgacacagcaacctggtgcagctgctgggggtgatcgtggaggagaagagcggcctctatattgtcactgagtatatggccaagggcagcctagtagattacctgcggtcgcgtgggaggtcggtcctaggcggagactgcctgctcaagttttccttagatgtctgtgaagccatggagtacctggaagccaacaacttcgtccaccgggacctggcggcgaggaatgtgttggtctcagaggacaacattgccaaggtcagcgatttcgggctgacaaaggaagcgtcgtccactcaggacacggggaagctgcctgtgaagtggacggcacccgaagcacttagagaaaagaaattctccaccaaatcggacgtgtggagcttcgggatcctcctctgggaaatctactccttcgggcgagtgccttatccgagaatccccctgaaggacgtggtgccccgggtggagaagggctataagatggaccctccagacggctgcccggccatcgtctacgaggtgatgaagaagtgctggacgctggacccagggcaccggccgtccttccaccagctccgtgaacagctagtgcatatcaaagagaaggagctctacctgtga

SEQ ID NO: 38 - DNA, 1353 bp, Gallus gallus
atgtcagggatgcaggccgtttggccatccggtacagaatgtatcgccaagtacaacttccacggtacggccgagcaggacctgccgttcagcaagggagacgtcctcaccatcgtcgccgtcaccaaggaccccaactggtacaaggcgaagaacaaggtgggccgggagggcatcatccccgctaactacgtgcagaagagggaaggagtgaaggctggcatcaagctcagcctcatgccgtggttccatgggaagatcacacgggagcaggcagagaggctgctgtacccacccgagacggggctgttcctggtgcgggagagcaccaactaccctggggactacaccctgtgtgtgagctgtgagggcaaggtggagcactaccgcatcatttactcctccagcaagctgagcatcgatgaggaggtctacttcgagaacctgatgcagcttgtggagcattacaccacggacgccgacgggctctgcacgcgcctcatcaaaccgaaggtgatggaggggacggtggcagctcaggacgagttctcccgcagtggctgggccctcaacatgaaggacctcaagctgctgcaaatcattggcaaaggggaatttggagatgtgatgctgggtgattaccgggggaacaaagtcgccgtcaagtgcattaaaaatgacgccacagcgcaggctttcctggcagaagcatccgtgatgacgcagctccgacacagcaacctggtgcagctgctgggggtgatcgtggaggagaagagcggcctctacattgtcactgagtatatggccaagggcagcctagtagattacctgcggtcgcgtgggaggtcggtcctaggcgcagactgcctgctcaagttttccttagatgtctgtgaagccatggagtacctggaagccaacaacttcgtccaccgggacctggcggcgaggaatgtgttggtctcagaggacaacattgccaaggtcagcgatttcgggctgacaaaggaagcgtcgtccactcaggacacggggaagctgcctgtgaagtggacggcacccgaagcacttagagaaaagaaattctccaccaaatcggacgtgtggagcttcgggatcctcctctgggaaatctactccttcgggcgagtgccttatccgagaatccccctgaaggacgtggtgccccgggtggagaagggctataagatggaccctccagacggctgcccggccatcgtctacgaggtgatgaagaagtgctggacgctggacccagggcaccggccgtccttccaccagctccgtgaacagctagtgcatatcaaagagaaggagctctacctgtga

SEQ ID NO: 39 - protein, 450 aa, Gallus gallus
MSGMQAVWPSGTECIAKYNFHGTAEQDLPFSKGDVLTIVAVTKDPNWYKAKNKVGREGIIPANYVQKREGVKAGIKLSLMPWFHGKITREQAERLLYPPETGLFLVRESTNYPGDYTLCVSCEGKVEHYRIIYSSSKLSIDEEVYFENLMQLVEHYTTDADGLCTRLIKPKVMEGTVAAQDEFSRSGWALNMKDLKLLQIIGKGEFGDVMLGDYRGNKVAVKCIKNDATAQAFLAEASVMTQLRHSNLVQLLGVIVEEKSGLYIVTEYMAKGSLVDYLRSRGRSVLGADCLLKFSLDVCEAMEYLEANNFVHRDLAARNVLVSEDNIAKVSDFGLTKEASSTQDTGKLPVKWTAPEALREKKFSTKSDVWSFGILLWEIYSFGRVPYPRIPLKDVVPRVEKGYKMDPPDGCPAIVYEVMKKCWTLDPGHRPSFHQLREQLVHIKEKELYL

SEQ ID NO: 40 - protein, 450 aa, Gallus gallus
MSGMQAVWPSGTECIAKYNFHGTAEQDLPFSKGDVLTIVAVTKDPNWYKAKNKVGREGIIPANYVQKREGVKAGIKLSLMPWFHGKITREQAERLLYPPETGLFLVRESTNYPGDYTLCVSCEGKVEHYRIIYSSSKLSIDEEVYFENLMQLVEHYTTDADGLCSRLIKPKVMEGTVAAQDEFSRSGWALNMKDLKLLQIIGKGEFGDVMLGDYRGNKVAVKCIKNDATAQAFLAEASVMTQLRHSNLVQLLGVIVEEKSGLYIVTEYMAKGSLVDYLRSRGRSVLGGDCLLKFSLDVCEAMEYLEANNFVHRDLAARNVLVSEDNIAKVSDFGLTKEASSTQDTGKLPVKWTAPEALREKKFSTKSDVWSFGILLWEIYSFGRVPYPRIPLKDVVPRVEKGYKMDPPDGCPAIVYEVMKKCWTLDPGHRPSFHQLREQLVHIKEKELYL

SEQ ID NO: 41 - DNA, 1353 bp, Xenopus tropicalis
atgtcagtggtgcaggccccttggcaagctggcacagaatgcattgctaactatgacttccagggtaaagctgagcaggacctgcattttagtaaaggtgaagtgctgaccattgtggctgtgacaaaggatccaaattggtacaaggcaaaaaacaaagtagggagagtgggattcatccctgcaaactatgtccaaaagagagaaggagtgaaatctggaaccaaactcagccttatgccgtggtttcatggcaagataacccgagagcaggctgagcgtctcttgtatccacctgaaacgggcttattccttgtacgggagagtacaaactaccctggagattatactctgtgtgtgagctgtgaagggaaagtggagcattaccgcattatctattcttctggcaagctgagcattgatgaagaggaatactttgaaaatctcatgcagctggtggagcactataccaatgatgcagatggcctgtgcacaaatttgatgaagcccaaattggtggagggaactgtagctgcccaggatgaattctcccggagtggctgggccctcaagatgagagatctcaaactgctgcacaccattggcaagggggaatttggagatgtcatgcttggtgaacatcaaggagtgaaagtagctgtgaaatgtatcaagaacgatgccacggcacaagcatttgtagcagaagctatggtgatgacgcaattgcaacataacaatcttgtgcagctacttggagtgattgttgaagataaaagtggtttgtttatcgtcacagaatttatggcaaagggaagcctagtggattatttgaggtctcggggaaggtcagtgctaggtggcgaatgtctactaaagttctcactggatgtatcagaaggtatggcatatcttgagagtaataactttgtgcacagagatctagcggcacgcaatgtgttggtatcagaagaaaatattgctaaggtcagtgactttggactcaccaaggaagcatccgccatacaggacacaagcaaactgcctgttaagtggacagcaccagaagcgttgcgggataagctattttcaaccaagtctgatgtttggagctttggaattctgttatgggagatctattcctttgggcgagtgccttatccacgcattgcccttaaagatgtggtaccaaaggtggagaatgggtataaaatggacgcacccgatggatgtcctcctgttgtatatgatttgatgaagcagtgttggcatctggacccaaaacagcgacccacttttaggaatctgcgagaacagctagagcatatcaaagcgaaggaactgtttcactga

SEQ ID NO: 42 - protein, 450 aa, Xenopus tropicalis
MSVVQAPWQAGTECIANYDFQGKAEQDLHFSKGEVLTIVAVTKDPNWYKAKNKVGRVGFIPANYVQKREGVKSGTKLSLMPWFHGKITREQAERLLYPPETGLFLVRESTNYPGDYTLCVSCEGKVEHYRIIYSSGKLSIDEEEYFENLMQLVEHYTNDADGLCTNLMKPKLVEGTVAAQDEFSRSGWALKMRDLKLLHTIGKGEFGDVMLGEHQGVKVAVKCIKNDATAQAFVAEAMVMTQLQHNNLVQLLGVIVEDKSGLFIVTEFMAKGSLVDYLRSRGRSVLGGECLLKFSLDVSEGMAYLESNNFVHRDLAARNVLVSEENIAKVSDFGLTKEASAIQDTSKLPVKWTAPEALRDKLFSTKSDVWSFGILLWEIYSFGRVPYPRIALKDVVPKVENGYKMDAPDGCPPVVYDLMKQCWHLDPKQRPTFRNLREQLEHIKAKELFH

SEQ ID NO: 43 - DNA, 1575 bp, Homo sapiens
atgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaa

SEQ ID NO: 44 - DNA, 1575 bp, Homo sapiens; identical to SEQ ID NO: 43

SEQ ID NO: 45 - DNA, 1575 bp, Homo sapiens; identical to SEQ ID NO: 43

SEQ ID NO: 46 - protein, 524 aa, Homo sapiens
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 47 - protein, 524 aa, Homo sapiens; identical to SEQ ID NO: 46

SEQ ID NO: 48 - protein, 524 aa, Homo sapiens; identical to SEQ ID NO: 46

SEQ ID NO: 49 - DNA, 1575 bp, Pan troglodytes
atgtctgataacggagaactggaagacaagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaaggggcttctggtacagttttcactgctactgacgttgcattgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacctgcatggatgaagcacagattgctgctgtatgcagagagtgtttacaggcattggagtttttacatgctaatcaagtgatccacagagacatcaaaagtgacaatgtacttttgggaatggaaggatcggttaaactcactgactttggtttctgtgcccagatcacccctgagcagagcaaacgcagtaccatggtcggaacgccatactggatggcaccagaggtggttacacggaaagcgtatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaa

SEQ ID NO: 50 - protein, 524 aa, Pan troglodytes; identical to SEQ ID NO: 46

SEQ ID NO: 51 - DNA, 1575 bp, Macaca mulatta
atgtctgataacggagaactggaagacaagcccccagcacctcctgtgcgaatgagcagcaccatctttagcactggaggcaaagaccccttgtcagccaatcacagtttgaaacctttgccctctgttccggaggagaagaagcccaggcacaaaatcatctccatattctcaggcacagagaaaggaagtaaaaagaaagaaaaggaacggccagaaatttctcctccatctgattttgaacacaccatccatgttggctttgatgctgttactggagaattcactggcatgccagaacagtgggctcgattactacagacctccaacatcaccaaactagagcaaaagaagaatcctcaggctgtgctggatgtcctcaagttctacgactccaacacagtgaagcagaagtatctgagctttactcctccggagaaagatggcttcccttctggaacaccagcactgaacgccaagggaacagaaacacccgcagtagtgacagaggaagatgatgatgatgaagagactgctcctcctgttattgccccacgaccagatcatacgaaatcaatttacacacggtctgtaattgaccccgttcctgcaccagttggtgattcaagtgttgatggtggtgccaagtcttcagacaaacagaaaaagaagactaaaatgacagatgaagaaattatggagaaattaagaactattgtgagcataggtgaccctaagaaaaaatatacaagatatgaaaaaattggacaaggggcttctggtacagttttcactgctactgacgttgcattgggacaggaggttgctatcaaacagattaatttacagaaacagccaaagaaggaattgatcattaatgagattctggtgatgaaagaattaaaaaatcccaacatagttaacttcttggacagttacctggtaggagatgaattgtttgtggtcatggaataccttgctggtggatcgctcactgatgtggtaacagaaacctgcatggatgaagcacagattgctgctgtatgcagagagtgcttgcaggcgttggagtttttacatgctaatcaagtgatccacagagacatcaaaagcgacaatgtccttttgggaatggaaggatcggttaagctcactgactttggtttctgtgcccagatcacccccgagcagagcaaacgcagtaccatggtcggaaccccatactggatggcaccagaggtggttacacggaaagcttatggccccaaagtcgacatatggtctctgggtatcatggctattgagatggtagaaggagagcctccatacctcaatgaaaatcccttgagggccttgtacctaatagcaactaatggaaccccagagcttcagaatccagagaaactttccccaatatttcgagatttcttaaatcgatgtttggaaatggatgtggaaaaaaggggttcagccaaagaattattacagcatcctttcttgaaactggccaaaccattatctagcttgacaccactgatcatggcagctaaagaagcgatgaagagtaaccgttaa

SEQ ID NO: 52 - DNA, 1575 bp, Macaca mulatta
atgtctgataacggagaactggaagacaagcccccagcacctcctgtgcgaatgagcagcaccatctttagcactggaggcaaagaccccttgtcagccaatcacagtttgaaacctttgccctctgttccggaggagaagaagcccaggcacaaaatcatctccatattctcaggcacagagaaaggaagtaaaaagaaagaaaaggaacggccagaaatttctcctccatctgattttgaacacaccatccatgttggctttgatgctgttactggagaattcactggcatgccagaacagtgggctcgattactacagacctccaacatcaccaaactagagcaaaagaagaatcctcaggctgtgctggatgtcctcaagttctacgactccaacacagtgaagcagaagtatctgagctttactcctccggagaaagatggcttcccttctggaacaccagcactgaacgccaagggaacagaaacacccgcagtagtgacagaggaagatgatgatgatgaagagactgctcctcctgttattgccccacgaccagatcatacgaaatcaatttacacacggtctgtaattgaccccgttcctgcaccagttggtgattcaagtgttgatggtggtgccaagtcttcagacaaacagaaaaagaagactaaaatgacagatgaagaaattatggagaaattaagaactattgtgagcataggtgaccctaagaaaaaatatacaagatatgaaaaaattggacaaggggcttctggtacagttttcactgctactgacgttgcattgggacaggaggttgctatcaaacagattaatttacagaaacagccaaagaaggaattgatcattaatgagattctggtgatgaaagaattaaaaaatccaaacatagttaacttcttggacagttacctggtaggagatgaattgtttgtggtcatggaataccttgctggtggatcgctcactgatgtggtaacagaaacctgcatggatgaagcacagattgctgctgtatgcagagagtgtctgcaggcgttggagtttttacatgctaatcaagtgatccacagagacatcaaaagcgacaatgtccttttgggaatggaaggatcggttaagctcactgactttggtttctgtgcccagatcacccccgagcagagcaaacgcagtaccatggtcggaaccccatactggatggcaccagaggtggttacacggaaagcttatggccccaaagtcgacatatggtctctgggtatcatggctattgagatggtagaaggagagcctccatacctcaatgaaaatcccttgagggccttgtacctaatagcaactaatggaaccccagagcttcagaatccagagaaactttccccaatatttcgagatttcttaaatcgatgtttggaaatggatgtggaaaaaaggggttcagccaaagaattattacagcatcctttcttgaaactggccaaaccattatctagcttgacaccactgatcatggcagctaaagaagcgatgaagagtaaccgttaa

SEQ ID NO: 53 - protein, 524 aa, Macaca mulatta
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNAKGTETPAVVTEEDDDDEETAPPVIAPRPDHTKSIYTRSVIDPVPAPVGDSSVDGGAKSSDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 54 - protein, 524 aa, Macaca mulatta; identical to SEQ ID NO: 53

SEQ ID NO: 55 - DNA, 1575 bp, Canis familiaris
atgtccgataacggagaactggaagacaagcctccagcacctcctgtgcgaatgagcagtaccatttttagcactggaggcaaagatcctttgtcagccaatcacagtttgaaacctttgccctccgttccagaggaaaaaaagcccaggaataaaatcatctctatattctccggcacagagaaaggaagtaagaagaaagaaaaggaacggccagaaatttctcctccatctgattttgagcataccatccatgttggctttgatgcggttacgggagaatttactggcatgccagaacagtgggctcgattattacagacctccaatatcaccaaactagagcaaaagaagaatcctcaggctgtgctggatgtcttaaagttctatgactccaacacagtgaagcagaaatacctgagctttactcctactgagaaagatggcttcccttctggaacacccacactgagtgccaagggttcagaaacagcagcagtagtagcagaggaagatgatgatgatgaagaggctgctcctcctgttattgccccacgaccggatcatacaaaatcaatttatacacggtctgtaattgaccctattcctgcaccagttggtgattctaatgttgatagcggtgccaagtcttctgacaaacagaaaaagaagaccaaaatgacagatgaagagattatggaaaaattaagaactattgtgagcataggtgaccctaagaaaaaatacacaagatacgaaaaaattgggcaaggggcttctggtacagttttcactgctactgatgtggcattgggacaggaggttgctatcaaacagattaatttacagaaacagccaaagaaggaattaatcattaatgagattctggtgatgaaagaattaaagaatcccaacatagttaacttcttggacagttacctgatgggagacgaattgtttgtagtaatggagtaccttgccgggggatcacttactgatgttgtaacagaaacctgcatggatgaagcacagattgctgctgtatgcagagagtgtttacaggcattggagtttttacatgctaatcaagtgatccacagagacatcaaaagtgacaacgtgcttttggggatggaaggatcagttaaacttactgactttgggttctgtgcccagatcacccctgagcagagcaagagaagtaccatggttggaacgccatactggatggcaccagaggtggttacacggaaagcttatggccctaaagtggacatatggtctctgggtatcatggctattgagatgatagaaggagagccgccatacctcaatgaaaatcccttgagggccttgtacctgatagcaactaatggaactccagaacttcagaatccagagaagctttccccaatatttcgggatttcttaaaccgttgtttggagatggatgtggagaaaaggggttcggccaaagaattattacagcatcccttcctgaaactggccaaacctttgtccagcttgacaccactgatcatggcagctaaagaagcaatgaagagtaaccgttag

SEQ ID NO: 56 - protein, 524 aa, Canis familiaris
MSDNGELEDKPPAPPVRMSSTIFSTGGKDPLSANHSLKPLPSVPEEKKPRNKIISIFSGTEKGSKKKEKERPEISPPSDFEHTIHVGFDAVTGEFTGMPEQWARLLQTSNITKLEQKKNPQAVLDVLKFYDSNTVKQKYLSFTPTEKDGFPSGTPTLSAKGSETAAVVAEEDDDDEEAAPPVIAPRPDHTKSIYTRSVIDPIPAPVGDSNVDSGAKSSDKQKKKTKMTDEEIMEKLRTIVSIGDPKKKYTRYEKIGQGASGTVFTATDVALGQEVAIKQINLQKQPKKELIINEILVMKELKNPNIVNFLDSYLMGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMIEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 57 - DNA, 1575 bp, Bos taurus
atgtctgataacggagaactggaagacaagcctccggcgcccccagtgcgaatgagcagtactatttttagcactggaggcaaagaccctttatcagccaatcacagtttgaaacctttgccttccgttccagaggaaaaaaagcccaggaataaaatcatctctatattttcaagcacagagaaaggaagtaagaagaaagagaaggaaaggccagaaatttctcctccgtctgattttgagcataccatccatgttggctttgatgctgttactggagaattcactggcatgccagaacagtgggctcgattactgcagacctccaatatcaccaaactagagcaaaagaagaatcctcaggcagtgctggacgtcttgaagttctatgactctaatacagtgaagcagaaatatctgagctttactcctcctgagaaagatggcttcccttctggaacaccagcactgaataccaagggatcggaaacatcagcagtagtaacagaggaagatgacgatgatgaagaggctcttcctcctgttattgctccacgaccagatcatacaaaatcaatttatacacgatctgtaattgatcctattcctgcaccagttggtgattctaatgttgatggtggtgccaagacttcagacaaacagaaaaagaaggccaaaatgacagatgaagagattatggagaaattaagaactattgtaagcataggtgaccctaagaaaaaatacacaagatatgaaaaaattgggcaaggggcttctggcacagttttcactgctacagatgtggcattgggacaagaggttgctattaagcagattaatttacagaaacagccaaagaaggaattgatcattaatgagattctggtgatgaaagaattaaagaatcccaacatagttaatttcttggacagttacctggtgggagatgaattgtttgtggtcatggagtacctggccggaggatcccttactgatgttgtcacagagacatgcatggatgaagcccagatagctgctgtgtgcagagagtgtttacaggcattggagtttttacatgctaatcaagtgatccacagagacatcaaaagtgacaatgtgcttttgggcatggaaggatctgttaaacttactgactttggtttctgtgcccagatcacccctgagcagagtaagcggagtaccatggttggaacgccatactggatggcaccagaggtggttacacggaaagcttatggccccaaagtagacatctggtctctgggtatcatggctattgaaatggtagaaggagagcctccatacctcaatgaaaatcctttgagggccttgtacctgatagcaactaatggaaccccagaacttcagaatccagagaagctttccccaatatttcgggatttcttaaatcgatgtttggagatggatgtggagaaaaggggttcagccagagaattgttacagcatcccttcctgaaactggccaagccgttatccagcttgacaccactgattatggcagctaaagaagcaatgaagagtaaccgttaa

SEQ ID NO: 58 - protein, 524 aa, Bos taurus
MSDNGELEDKPPAPPVRMSSTIFSTGGKDPLSANHSLKPLPSVPEEKKPRNKIISIFSSTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNTKGSETSAVVTEEDDDDEEALPPVIAPRPDHTKSIYTRSVIDPIPAPVGDSNVDGGAKTSDKQKKKAKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSARELLQHPFLKLAKPLSSLTPLIMAAKEAMKSNR

SEQ ID NO: 59 - DNA, 1575 bp, Mus musculus
atgtctgataacggagagctagaagacaagcccccagcacctccagttcggatgagcagtaccatttttagcaccggaggaaaagatcctttatcagccaatcacagtttgaaacctttgccttctgttccagaggaaaaaaaacccaggaacaaaatcatctccatattctctggcacagaaaaaggaagtaaaaagaaagaaaaagaacggccagagatttctcccccatctgattttgagcacaccatccatgttggctttgatgctgttacgggagagttcactggcatgccagaacagtgggcgcggctgttgcagacctccaacattaccaaactcgagcagaagaagaaccctcaggcagtgctggatgtcttgaagttctacgactccaacactgtgaaacagaagtacctgagtttcactcctcctgagaaagatggcttcccttctggaacaccagcactgaacaccaaggggtcagagacatcagctgtagtgacagaggaagatgatgatgatgaagacgctgctcctcccgtcattgcccctcggccagatcatacaaaatcaatttacacacggtctgtcatcgaccccattcctgctccagttggtgattctaatgttgacagtggtgccaagtcttcagacaaacagaaaaagaaagccaagatgaccgatgaagagattatggagaaattaagaactattgtgagcataggggacccaaagaaaaaatacacaagatatgaaaaaattgggcaaggggcttctggaacagtttttactgccactgatgtggccctggggcaagaggttgctatcaagcagattaatttacagaaacaaccaaagaaggaattgatcattaatgaaattctggtgatgaaagagttaaagaatcccaacatagttaacttcttggacagttacctggtaggagatgagttgtttgtggtaatggagtacctcgctggtgggtccctcactgatgttgtaacagaaacctgcatggacgaagcgcagattgccgccgtgtgcagagagtgtttacaggcgttggagtttttacatgctaatcaagtgatccacagagacatcaaaagtgacaatgtgcttttgggaatggaaggctcagttaaacttactgacttcggcttctgtgcccagatcactcctgaacagagcaaacgcagtactatggttggaacaccgtactggatggcaccagaggtggtgacacggaaagcctatggtcccaaagttgacatatggtctctgggcatcatggctatcgagatggttgaaggagagcctccatacctcaacgaaaatcctctgcgggcattatacctgatagctacaaatggaactcctgaacttcagaatccagaaaaactttccccaatatttcgggatttcttaaatcggtgtttggaaatggatgtggagaaaaggggttcggccaaggaactgttacagcatcctttcctgaaactggccaaaccattgtctagcttgacgccactgatcctggcagctaaagaagcaatgaagagtaaccgctaa

SEQ ID NO: 60 - DNA, 1629 bp, Mus musculus
atgtctgataacggagagctagaagacaagcccccagcacctccagttcggatgagcagtaccatttttagcaccggaggaaaagatcctttatcagccaatcacagtttgaaacctttgccttctgttccagaggaaaaaaaacccaggaacaaaatcatctccatattctctggcacagaaaaaggaagtaaaaagaaagaaaaagaacggccagagatttctcccccatctgattttgagcacaccatccatgttggctttgatgctgttacgggagagttcactggcatgccagaacagtgggcgcggctgttgcagacctccaacattaccaaactcgagcagaagaagaaccctcaggcagtgctggatgtcttgaagttctacgactccaacactgtgaaacagaagtacctgagtttcactcctcctgagaaagatggcttcccttctggaacaccagcactgaacaccaaggggtcagagacatcagctgtagtgacagaggaagatgatgatgatgaagacgctgctcctcccgtcattgcccctcggccagatcatacaaaatcaatttacacacggtctgtcatcgaccccattcctgctccagttggtgattctaatgttgacagtggtgccaagtcttcagacaaacagaaaaagaaagccaagatgaccgatgaagagattatggagaaattaagaactattgtgagcataggggacccaaagaaaaaatacacaagatatgaaaaaattgggcaaggggcttctggaacagtttttactgccactgatgtggccctggggcaagaggttgctatcaagcagattaatttacagaaacaaccaaagaaggaattgatcattaatgaaattctggtgatgaaagagttaaagaatcccaacatagttaacttcttggacagttacctggtaggagatgagttgtttgtggtaatggagtacctcgctggtgggtccctcactgatgttgtaacagaaacctgcatggacgaagcgcagattgccgccgtgtgcagagagtgtttacaggcgttggagtttttacatgctaatcaagtgatccacagagacatcaaaagtgacaatgtgcttttgggaatggaaggctcagttaaacttactgacttcggcttctgtgcccagatcactcctgaacagagcaaacgcagtactatggttggaacaccgtactggatggcaccagaggtggtgacacggaaagcctatggtcccaaagttgacatatggtctctgggcatcatggctatcgagatggttgaaggagagcctccatacctcaacgaaaatcctctgcgggcattatacctgatagctacaaatggaactcctgaacttcagaatccagaaaaactttccccaatatttcgggatttcttaaatcggtgtttggaaatggatgtggagaaaaggggttcggccaaggaactgttacagcatcctttcctgaaactggccaaaccattgtctagcttgacgccactgatcctggcagctaaagaagcaatgaagagtaaccgctaacatcgtcaccgaggcctcctattcccttatccattttttaaaagaagtctttta

SEQ ID NO: 61 - protein, 524 aa, Mus musculus
MSDNGELEDKPPAPPVRMSSTIFSTGGKDPLSANHSLKPLPSVPEEKKPRNKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNTKGSETSAVVTEEDDDDEDAAPPVIAPRPDHTKSIYTRSVIDPIPAPVGDSNVDSGAKSSDKQKKKAKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLILAAKEAMKSNR

SEQ ID NO: 62 - protein, 524 aa, Mus musculus; identical to SEQ ID NO: 61

SEQ ID NO: 63 - DNA, 1575 bp, Rattus norvegicus
atgtctgataacggggagctagaggacaagcccccagcacctccagtgcggatgagcagcaccatttttagcactggaggaaaggatcctttatcagccaatcacagtttgaagcctttgccttctgttccagaggaaaaaaaaccgaggaacaaaatcatctccatattctcaagcacagaaaaaggaagtaaaaagaaagaaaaagaacggccagagatttctccgccgtctgattttgagcataccatccatgttggctttgatgctgttacgggagagttcactggcatgccagagcagtgggcacggctgttgcagacctccaacattaccaaactggagcagaagaagaacccgcaggctgtgctggatgtcttgaagttctacgactccaacactgtgaagcagaagtacctgagcttcactcctcctgagaaagatggctttccttctggaacaccagcactgaacaccaaggggtcagagacatcagctgtggtgacagaggaagacgatgacgatgaagatgctgctcctcccgtcattgcccctcggccagatcatacaaaatcaatctacacaaggtctgtcatcgaccctattcctgctccagttggtgactctaatgtcgacagtggtgccaagtcttcagacaaacagaaaaagaaagccaagatgaccgatgaagagattatggagaaattaagaactattgtgagcataggtgaccctaagaaaaaatacacaagatatgaaaaaatcgggcaaggggcttctggtacagtttttactgcaactgatgtggccctggggcaagaggttgctatcaagcagattaatttacagaaacaaccaaagaaggaattgatcattaatgaaattctggtgatgaaagagttaaagaatcccaacatagttaacttcttggacagttacctggtaggagacgagttgtttgtggtaatggagtaccttgctggtgggtccctcactgatgtcgtgacagaaacctgcatggatgaagcgcagatcgcagctgtgtgcagagagtgtttacaggcgttggagtttttacatgctaatcaagtgatccacagagacatcaaaagtgacaatgtgcttttgggaatggaaggctcagttaaactcactgattttggcttctgtgcccagatcacccctgaacagagcaaacgcagtactatggttggaacaccatactggatggcaccggaggtagtcacgcggaaagcctatggccccaaagttgacatatggtctctgggcatcatggctatcgaaatggtggaaggagagcctccatacctcaatgaaaatcctttacgggcattatacctgatagcaacgaatggaacacctgagctccagaatccagaaaaactttcccccatatttcgggatttcttaaatcggtgtttggaaatggatgtggagaagaggggttcagccaaagaactattacagcatcctttcctgaaactggccaaaccattatccagcttgacgcctctgatcctggcagctaaagaagcaatgaagagtaaccgctaa

SEQ ID NO: 64 - DNA, 1575 bp, Rattus norvegicus; identical to SEQ ID NO: 63

SEQ ID NO: 65 - DNA, 1575 bp, Rattus norvegicus; identical to SEQ ID NO: 63

SEQ ID NO: 66 - protein, 524 aa, Rattus norvegicus
MSDNGELEDKPPAPPVRMSSTIFSTGGKDPLSANHSLKPLPSVPEEKKPRNKIISIFSSTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNTKGSETSAVVTEEDDDDEDAAPPVIAPRPDHTKSIYTRSVIDPIPAPVGDSNVDSGAKSSDKQKKKAKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLILAAKEAMKSNR

SEQ ID NO: 67 - protein, 524 aa, Rattus norvegicus; identical to SEQ ID NO: 66

SEQ ID NO: 68 - protein, 524 aa, Rattus norvegicus; identical to SEQ ID NO: 66

SEQ ID NO: 69 - DNA, 1566 bp, Gallus gallus
atgtctgacaacggagaactggaagacaagccaccagctcctcctgtgcggatgagcagttatgggggaaaggacccgttgtctgccaaccacagcttgaaacctctgccctccgtaccagaagagagaaaacctaggaataaaatcatctccatattctctagcactgaaaaaggaagcaagaagaaggaaaaggaacgaccagaaatctccccgccgtcagactttgagcatactatccatgttggctttgatgctgtcactggagagttcactggaatgccagagcaatgggctcggttgctacagacctcaaacatcaccaagttagaacagaagaaaaaccctcaggcggtactagatgtgctgaaattctacgactccaaagacacagcaaaacagaaatatctgagcttttctgctccagaaaaagatggcttcccttcaggaacaccaacgaccaatgccaaaggttcagagccatcaacagctgtggcagatgacgatgacgatgatgaagaagcacctcctcctattattgctccgcggccagatcacacgaaatcgatttatacacggtctgtaattgaccccatccctgcaccagctggtgacgcttctgttgatggtgggacaaagtcaggtgataagcagaaaaagaagaccaaaatgtcagatgaagagatcatggaaaaactacgtaccattgtgagcataggtgatcccaagaaaaaatacaccagatatgaaaaaattgggcagggggcttcaggtacagttttcacagctattgacgtggctactgggcaggaggttgctatcaaacagataaacctgcagaaacagcccaagaaggagttgattattaatgagatcttggtaatgaaggaactaaagaaccccaacatagtcaacttcctggacagttacctcgtaggagatgaactgtttgtggtgatggagtatctagctggaggctcactaacagatgtggttacggaaacatgtatggatgaagcacagattgctgctgtttgcagggagtgcttgcaagcgcttgagttcctccatgccaaccaggtcatccacagagatataaagagcgacaacgtgctgctaggaatggatggatcagttaaactaaccgactttggtttctgtgctcagatcaccccagagcagagcaagcgcagcactatggttggaacaccttactggatggctcctgaagtcgtcacacggaaagcctatggccctaaagtggatatctggtccctaggcatcatggctattgagatggtggaaggagaacccccgtacctcaatgaaaaccccctgagggcgttatatttgatagcaactaacggcacaccagagcttcagaaccctgagaaactgtccccaatattccgggatttcttaaaccgatgtttggagatggatgttgagaaaagaggatcagccaaagaattgctacagcatcccttcttgaaattggccaaacctctgtctagcttgacgccactgatcctggcagccaaagaagcaatgaagagtaaccgctaa

SEQ ID NO: 70 - DNA, 1566 bp, Gallus gallus; identical to SEQ ID NO: 69

SEQ ID NO: 71 - protein, 521 aa, Gallus gallus
MSDNGELEDKPPAPPVRMSSYGGKDPLSANHSLKPLPSVPEERKPRNKIISIFSSTEKGSKKKEKERPEISPPSDFEHTIHVGFDAVTGEFTGMPEQWARLLQTSNITKLEQKKNPQAVLDVLKFYDSKDTAKQKYLSFSAPEKDGFPSGTPTTNAKGSEPSTAVADDDDDDEEAPPPIIAPRPDHTKSIYTRSVIDPIPAPAGDASVDGGTKSGDKQKKKTKMSDEEIMEKLRTIVSIGDPKKKYTRYEKIGQGASGTVFTAIDVATGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMDGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLILAAKEAMKSNR

SEQ ID NO: 72 - protein, 521 aa, Gallus gallus; identical to SEQ ID NO: 71

SEQ ID NO: 73 - DNA, 1557 bp, Xenopus tropicalis
atgtctgataacggggagcttgaagataagccgccagctcctccagctcggattagcagcacagggacaaaagatcctctgaccagcaaccacagtcataaacctttacctttaatccctgaaaaacccaggaataaaattatttcaatgttttctggcacagaaaaaggaagcagaaaaaaagaaagggaaaggccagagatttcaccaccgtcagattttgagcacactattcatgtgggctttgatgctgtcactggagaattcactggaatgccagagcaatgggcacggttactgcagacctcaaacattactaaactcgaacagaagaaaaatccacaagctgtcctggatgttttaaagttttatgactccaaacacacagacaagcagaaatatctaagcttctctgcaccagataaagatgggcttccctctggtgtttcctctgcacctaatgcaaaaggctctgaaccttcaacagcagcaacagatgatgatagcgatgatgataaggctcctcctcctgttattgctccaaggccagaacacaccaaatcaatgtatacacggtctgtaattgacccaatacctccaccccctggagattcagacagtgctgcaaaggctggagaccggcagaaaaagaaaacaaagatgagcgatgaagagattatggaaaaacttagaactatagtaagcataggagaccccaagaaaaaatatactagatatgaaaaaattggacaaggggcctctggaactgtatttactgctattgatgtagctaccggacaggaggttgcaatcaaacagataaatcttcagaagcagcccaagaaagaactgataatcaatgagattctagtgatgaaagaattgaagaaccccaatatagtaaatttcctggacagtttcttggtgagtgacgagctgtatgttgtaatggagtatttggctggaggatcccttacagacgtagtcacagaaacctgtatggatgaggcacagatagcagctgtctgcagagagtgtctgcaagctttggaattcctacatgcgaaccaggtcattcacagagacataaagagtgacaatgttctccttggaatggatggttctgtcaaactgaccgactttggcttctgtgcacaaattaccccagaacagagcaagcgaagcaccatggtgggaacaccatactggatggcaccagaagtggttacaaggaaagcatatggccccaaggtggatatctggtcacttggaattatggctattgaaatggtggaaggggaaccaccttatctcaacgaaaatcctttaagggctttgtatttgattgctactaatggaactccggaacttcagaaacctgaaaaactttcaccgatattccgggatttcttaaaccgctcacttgagatggatgtagaaaagagagggtccgctagagagctcttacagcacccattcctgaaactcgcaaaaccactgtccagcctcacaccgctaatcctggctgccaaagaagcgatgaagggaaaccgctaa

SEQ ID NO: 74 - DNA, 1557 bp, Xenopus tropicalis; identical to SEQ ID NO: 73

SEQ ID NO: 75 - DNA, 1557 bp, Xenopus tropicalis; identical to SEQ ID NO: 73

SEQ ID NO: 76 - protein, 518 aa, Xenopus tropicalis
MSDNGELEDKPPAPPARISSTGTKDPLTSNHSHKPLPLIPEKPRNKIISMFSGTEKGSRKKERERPEISPPSDFEHTIHVGFDAVTGEFTGMPEQWARLLQTSNITKLEQKKNPQAVLDVLKFYDSKHTDKQKYLSFSAPDKDGLPSGVSSAPNAKGSEPSTAATDDDSDDDKAPPPVIAPRPEHTKSMYTRSVIDPIPPPPGDSDSAAKAGDRQKKKTKMSDEEIMEKLRTIVSIGDPKKKYTRYEKIGQGASGTVFTAIDVATGQEVAIKQINLQKQPKKELIINEILVMKELKNPNIVNFLDSFLVSDELYVVMEYLAGGSLTDVVTETCMDEAQIAAVCRECLQALEFLHANQVIHRDIKSDNVLLGMDGSVKLTDFGFCAQITPEQSKRSTMVGTPYWMAPEVVTRKAYGPKVDIWSLGIMAIEMVEGEPPYLNENPLRALYLIATNGTPELQKPEKLSPIFRDFLNRSLEMDVEKRGSARELLQHPFLKLAKPLSSLTPLILAAKEAMKGNR

SEQ ID NO: 77 - protein, 518 aa, Xenopus tropicalis; identical to SEQ ID NO: 76

SEQ ID NO: 78 - protein, 518 aa, Xenopus tropicalis; identical to SEQ ID NO: 76

SEQ ID NO: 79 - DNA, 615 bp, Homo sapiens
atggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtga

SEQ ID NO: 80 - DNA, 915 bp, Homo sapiens
atggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctga

SEQ ID NO: 81 - protein, 304 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPDEDFS

SEQ ID NO: 82 - protein, 204 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGR

SEQ ID NO: 83 - DNA, 915 bp, Pan troglodytes
atggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgctcagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctga

SEQ ID NO: 84 - DNA, 615 bp, Pan troglodytes
atggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgctcagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtga

SEQ ID NO: 85 - protein, 304 aa, Pan troglodytes; identical to SEQ ID NO: 81

SEQ ID NO: 86 - protein, 204 aa, Pan troglodytes; identical to SEQ ID NO: 82

SEQ ID NO: 87 - DNA, 915 bp, Macaca mulatta
atggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccagtgccgccgtcgcccgcccaacctccgccgggggtgagcccctccagactccgaataggagatcaagagtttgattcattgcctgctttactggaattctacaaaatacactatttggacactacaacgttgatagaaccggtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctga

SEQ ID NO: 88 - DNA, 615 bp, Macaca mulatta
atggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccagtgccgccgtcgcccgcccaacctccgccgggggtgagcccctccagactccgaataggagatcaagagtttgattcattgcctgctttactggaattctacaaaatacactatttggacactacaacgttgatagaaccggtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtga

SEQ ID NO: 89 - protein, 304 aa, Macaca mulatta; identical to SEQ ID NO: 81

SEQ ID NO: 90 - protein, 204 aa, Macaca mulatta; identical to SEQ ID NO: 82

SEQ ID NO: 91 - DNA, 915 bp, Canis familiaris
atggcgggcaacttcgactcggaggagcggagtagctggtactgggggcggttgagccggcaggaggcggtggcgctgttgcagggccagcggcacggggtgtttctggtgcgggactcgagcaccagccccggggactatgtgctcagcgtctcggagaactcgcgcgtctcccactacatcatcaacagcagcggcccgcgcccgtctgtgccaccgtcgcccgcccagcctccgcccggggtgagcccctccagactccgaataggagatcaagagtttgattcattgcctgctttactggaattctacaaaatacattatttggacactacaacattgatagaaccagtttccagatccaggcagggtagtggagtgattctcaggcaggaggaggcagagtatgtgcgagccctctttgactttaatgggaatgatgaagaagatcttccctttaagaaaggagacatcctgagaatccgagataagcctgaagagcagtggtggaatgcagaggacagcgaaggcaagagggggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatttatgccagggtaatccagaagcgagtccctaatgcctacgacaagacagccttggctttggaggtcggtgagctggtaaaggttacgaagattaatgtgagtggtcagtgggaaggggaatgtaatggcaaacgaggtcacttcccattcacacatgtccgtctgctggatcaacagaatcctgatgaggacttcagctga

SEQ ID NO: 92 - DNA, 615 bp, Canis familiaris
atggcgggcaacttcgactcggaggagcggagtagctggtactgggggcggttgagccggcaggaggcggtggcgctgttgcagggccagcggcacggggtgtttctggtgcgggactcgagcaccagccccggggactatgtgctcagcgtctcggagaactcgcgcgtctcccactacatcatcaacagcagcggcccgcgcccgtctgtgccaccgtcgcccgcccagcctccgcccggggtgagcccctccagactccgaataggagatcaagagtttgattcattgcctgctttactggaattctacaaaatacattatttggacactacaacattgatagaaccagtttccagatccaggcagggtagtggagtgattctcaggcaggaggaggcagagtatgtgcgagccctctttgactttaatgggaatgatgaagaagatcttccctttaagaaaggagacatcctgagaatccgagataagcctgaagagcagtggtggaatgcagaggacagcgaaggcaagagggggatgattccagtcccttacgtcgagaagtatagacctgcctccgcctcagtatcggctctgattggaggtcggtga

SEQ ID NO: 93 - protein, 304 aa, Canis familiaris
MAGNFDSEERSSWYWGRLSRQEAVALLQGQRHGVFLVRDSSTSPGDYVLSVSENSRVSHYIINSSGPRPSVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPDEDFS

SEQ ID NO: 94 - protein, 204 aa, Canis familiaris
MAGNFDSEERSSWYWGRLSRQEAVALLQGQRHGVFLVRDSSTSPGDYVLSVSENSRVSHYIINSSGPRPSVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGR

SEQ ID NO: 95 - DNA, 915 bp, Bos taurus
atggcgggcaacttcgactcggaggagcggagtagctggtactgggggcggctgagtcggcaggaggcggtggcgctgttgcagggccagcggcacggggtgttcctggtgcgggactcgagcactagccccggggactatgtgctcagcgtctccgagaactcgcgcgtctcccactacatcatcaacagcagcggcccgcgcccgccggtgccaccgtcgcccgcccagcctccgcccggggtgagtccctccagactccgaataggagatcaagaatttgattcattgcctgctttactggaattctacaaaatacactatttggacactacaacgttgatagaaccagtttccagatccaggcagggtagtggagtgattctcaggcaggaagaggcagagtatgtacgagccctctttgactttaatgggaatgatgaagaagatcttccctttaagaaaggagacatcctgagaatccgggataagcctgaagagcagtggtggaatgcggaggacagcgaaggcaagagagggatgattccagtcccttacgtggagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatttatgccagggtaatccagaagcgagtccctaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctga

SEQ ID NO: 96 - DNA, 615 bp, Bos taurus
atggcgggcaacttcgactcggaggagcggagtagctggtactgggggcggctgagtcggcaggaggcggtggcgctgttgcagggccagcggcacggggtgttcctggtgcgggactcgagcactagccccggggactatgtgctcagcgtctccgagaactcgcgcgtctcccactacatcatcaacagcagcggcccgcgcccgccggtgccaccgtcgcccgcccagcctccgcccggggtgagtccctccagactccgaataggagatcaagaatttgattcattgcctgctttactggaattctacaaaatacactatttggacactacaacgttgatagaaccagtttccagatccaggcagggtagtggagtgattctcaggcaggaagaggcagagtatgtacgagccctctttgactttaatgggaatgatgaagaagatcttccctttaagaaaggagacatcctgagaatccgggataagcctgaagagcagtggtggaatgcggaggacagcgaaggcaagagagggatgattccagtcccttacgtggagaagtatagacctgcctccgcctcagtatcggctctgattggaggtcggtga

SEQ ID NO: 97 - protein, 304 aa, Bos taurus; identical to SEQ ID NO: 81

SEQ ID NO: 98 - protein, 204 aa, Bos taurus; identical to SEQ ID NO: 82

SEQ ID NO: 99 - DNA, 792 bp, Mus musculus
atggcgggcaacttcgactcggaggagcggagtagctggtactggggccgcctgagccggcaggaggcggtggcgctattgcagggccagcggcacggggtgttcctggtgcgggactcgagcaccagccccggggactatgtgcttagcgtctccgaaaactcgcgcgtctcccactacatcatcaacagcagcggcccgcgccctccagtgcctccgtcgcccgctcagcctccgccgggagtgagtccctccaggctccgaataggagatcaagaatttgattcattgcctgctttactggaattctacaaaatacactatttggacactacaacattgatagaaccagtggccagatcaaggcagggtagtggagtgattctcaggcaggaggaggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatttatgccagggttatccagaagcgagtccctaatgcctacgacaagacagccttggctttggagctcctgatggtttga

SEQ ID NO: 100 - DNA, 786 bp, Mus musculus
atggcgggcaacttcgactcggaggagcggagtagctggtactggggccgcctgagccggcaggaggcggtggcgctattgcagggccagcggcacggggtgttcctggtgcgggactcgagcaccagccccggggactatgtgcttagcgtctccgaaaactcgcgcgtctcccactacatcatcaacagcagcggcccgcgccctccagtgcctccgtcgcccgctcagcctccgccgggagtgagtccctccaggctccgaataggagatcaagaatttgattcattgcctgctttactggaattctacaaaatacactatttggacactacaacattgatagaaccagtggccagatcaaggcagggtagtggagtgattctcaggcaggaggaggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacctgcctccgcctcagtatcggctctgattggagctcctgatggtttgatctctctactaaggacttacgagtttaaaaagcaaattttatatttaagatactgttcttcttgggctggacagatggctcagcggttaagagcattgactgctcttccgaaggccctgagttcaaatcccagcaaccacatggtggctcacaaccatctgtaa

SEQ ID NO: 101 - DNA, 615 bp, Mus musculus
atggcgggcaacttcgactcggaggagcggagtagctggtactggggccgcctgagccggcaggaggcggtggcgctattgcagggccagcggcacggggtgttcctggtgcgggactcgagcaccagccccggggactatgtgcttagcgtctccgaaaactcgcgcgtctcccactacatcatcaacagcagcggcccgcgccctccagtgcctccgtcgcccgctcagcctccgccgggagtgagtccctccaggctccgaataggagatcaagaatttgattcattgcctgctttactggaattctacaaaatacactatttggacactacaacattgatagaaccagtggccagatcaaggcagggtagtggagtgattctcaggcaggaggaggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacctgcctccgcctcagtatcggctctgattggaggtcggtga

SEQ ID NO: 102 - DNA, 915 bp, Mus musculus
atggcgggcaacttcgactcggaggagcggagtagctggtactggggccgcctgagccggcaggaggcggtggcgctattgcagggccagcggcacggggtgttcctggtgcgggactcgagcaccagccccggggactatgtgcttagcgtctccgaaaactcgcgcgtctcccactacatcatcaacagcagcggcccgcgccctccagtgcctccgtcgcccgctcagcctccgccgggagtgagtccctccaggctccgaataggagatcaagaatttgattcattgcctgctttactggaattctacaaaatacactatttggacactacaacattgatagaaccagtggccagatcaaggcagggtagtggagtgattctcaggcaggaggaggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatttatgccagggttatccagaagcgagtccctaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctga

SEQ ID NO: 103 - DNA, 249 bp, Mus musculus
atggcgggcaacttcgactcggaggagcggagtagctggtactggggccgcctgagccggcaggaggcggtggcgctattgcagggccagcggcacggggtgttcctggtgcgggactcgagcaccagccccggggactatgtgcttagcgtctccgaaaactcgcgcgtctcccactacatcatcaacagcagcggcccgcgccctccagtgcctccgtcgcccgctcagcctccgccgggtcggtga

SEQ ID NO: 104 - protein, 263 aa, Mus musculus
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVARSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALELLMV

SEQ ID NO: 105 - protein, 261 aa, Mus musculus
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVARSRQGSGVILRQEEAEYVRALFDFNGNDEEDLPFKKGDILRIRDKPEEQWWNAEDSEGKRGMIPVPYVEKYRPASASVSALIGAPDGLISLLRTYEFKKQILYLRYCSSWAGQMAQRLRALTALPKALSSNPSNHMVAHNHL

SEQ ID NO: 106 - protein, 204 aa, Mus musculus
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVARSRQGSGVILRQEEAEYVRALFDFNGNDEEDLPFKKGDILRIRDKPEEQWWNAEDSEGKRGMIPVPYVEKYRPASASVSALIGGR

SEQ ID NO: 107 - protein, 304 aa, Mus musculus
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVARSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPDEDFS

SEQ ID NO: 108 - protein, 82 aa, Mus musculus
MAGNFDSEERSSWYWGRLSRQEAVALLQGQRHGVFLVRDSSTSPGDYVLSVSENSRVSHYIINSSGPRPPVPPSPAQPPPGR

SEQ ID NO: 109 - DNA, 915 bp, Rattus norvegicus
atggcaggcaacttcgactcggaggagcggagtagctggtactggggccgcttgagccggcaggaggcggtggcgctattgcagggccagcggcacggggttttcctggtgcgggactcgagcaccagccccggggactatgtgctcagcgtctccgaaaactcgcgcgtctcccactacatcatcaacagcagcggcccgcgccctccagtgcctccgtcgcccgctcagcctccgccgggagtgagtccctccaggctccgaataggagatcaagaatttgattcattgcctgctttactggaattctacaaaatacactatttggacactacaacactgatagaaccagtttccagatcaaggcagggtagtggagtgattctcaggcaggaggaggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacccgcctccgcctcagtatcggctctgattggaggtaaccaggagggttcccacccacagccactgggtgggccggagcctgggccctatgcccaacccagcgtcaacactccgctccctaacctccagaatgggcccatttatgccagggttatccagaagcgagtccctaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgaggaggacttcagctga

SEQ ID NO: 110 - DNA, 615 bp, Rattus norvegicus
atggcaggcaacttcgactcggaggagcggagtagctggtactggggccgcttgagccggcaggaggcggtggcgctattgcagggccagcggcacggggttttcctggtgcgggactcgagcaccagccccggggactatgtgctcagcgtctccgaaaactcgcgcgtctcccactacatcatcaacagcagcggcccgcgccctccagtgcctccgtcgcccgctcagcctccgccgggagtgagtccctccaggctccgaataggagatcaagaatttgattcattgcctgctttactggaattctacaaaatacactatttggacactacaacactgatagaaccagtttccagatcaaggcagggtagtggagtgattctcaggcaggaggaggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacccgcctccgcctcagtatcggctctgattggaggtcggtga

SEQ ID NO: 111 - protein, 304 aa, Rattus norvegicus
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPEEDFS

SEQ ID NO: 112 - protein, 204 aa, Rattus norvegicus; identical to SEQ ID NO: 82

SEQ ID NO: 113 - DNA, 918 bp, Gallus gallus
atggccgggcagttcgactccgaggaccgggggagctggtactgggggcggctgagccggggcgacgcggtgtcgctgctgcaggggcaacgccacgggaccttcctggtgcgcgactcgggctccatccccggcgacttcgtgctctcggtgtccgagagctcccgcgtctcgcactacatcgtcaacagcctggggccggcgggaggccggagggccggcggcgagggccctggggccccggggttgaatcccaccagatttcgaataggtgaccaggagtttgattctttgccatctttactggaattctacaaaatacactatttggacactacaaccttgatagaaccagtttcccgatccaggcagaacagtggcgttatcctcaggcaggaggaagttgaatatgtgcgagctctctttgactttaatggaaacgatgacgaagatcttccatttaagaaaggagacatactgaaaatccgggataaacctgaagagcaatggtggaatgcagaagacatggatggaaagaggggaatgatacctgttccttacgtcgagaagtgtagaccttcctctgcttcagtatctactctgactggaggtaaccaggatagttcccacccacaaccactgggtgggccggagccagggccctatgcccagcccagcatcaacactccgctccctaaccttcagaatggccctttttatgcccgggttatccagaagcgagtccctaatgcctacgacaagacagccttggctttggaggtcggtgagctggtaaaggtcacgaagattaacatgagtggtcagtgggaaggagaatgtaatggcaaacgtggtcactttccattcacacatgtccgcctgctggatcaacagaatcctgatgaggacttcagctga

SEQ ID NO: 114 - protein, 305 aa, Gallus gallus
MAGQFDSEDRGSWYWGRLSRGDAVSLLQGQRHGTFLVRDSGSIPGDFVLSVSESSRVSHYIVNSLGPAGGRRAGGEGPGAPGLNPTRFRIGDQEFDSLPSLLEFYKIHYLDTTTLIEPVSRSRQNSGVILRQEEVEYVRALFDFNGNDDEDLPFKKGDILKIRDKPEEQWWNAEDMDGKRGMIPVPYVEKCRPSSASVSTLTGGNQDSSHPQPLGGPEPGPYAQPSINTPLPNLQNGPFYARVIQKRVPNAYDKTALALEVGELVKVTKINMSGQWEGECNGKRGHFPFTHVRLLDQQNPDEDFS

SEQ ID NO: 115 - DNA, 891 bp, Xenopus tropicalis
atggcgggcaacttcgactccgaggaccgggcgagctggtactggggcaagctgaacagacaagaggcggtcaatcttctgcagggccagcggcacggtgtgtttttagttcgagactccacaactatacctggtgactacgtattgtctgtctctgagaactccaaggtttcccactatatcatcaacagcgtcagcaacaaccggcagagtgggactggaatgatccagtcccgattcagaataggtgaccaagagtttgattccttaccatctcttttggaattttataagatccattacctggacactacaactttaatagaaccagtttccaagtctaaacaatctggtgtaatccaaagacaagaagaagttgaatacgtgcgagctctctttgactttaatggcaatgatgatgaagatcttccatttaagaaaggagacatcctgagaattcgagataagcccgaggagcagtggtggaatgctgaggacaacgatggaagacggggcatgatacctgtgccttacgtcgagaagtacaggcctccctcttcagcagggtcagccctgattggaggtaaccaggaaaactcgcacccgcaaccactgggtgggccggagccagggccctatgcccagcccagcgtcaacactccgctgcctaaccttcagaatgggcccatttttgccagggttatccagaagcgcgtccctaatgcctacgacaagacagccttggctttggaggttggtgatctagtaaaggtaacaaagattaatgtcagtggccagtgggaaggagagtgcaacgggaaatatggtcattttccatttacacatgtgcgtctgctggatcaacagaacccagaggaggactttagctga

SEQ ID NO: 116 - DNA, 591 bp, Xenopus tropicalis
atggcgggcaacttcgactccgaggaccgggcgagctggtactggggcaagctgaacagacaagaggcggtcaatcttctgcagggccagcggcacggtgtgtttttagttcgagactccacaactatacctggtgactacgtattgtctgtctctgagaactccaaggtttcccactatatcatcaacagcgtcagcaacaaccggcagagtgggactggaatgatccagtcccgattcagaataggtgaccaagagtttgattccttaccatctcttttggaattttataagatacattacctggacactacaactttaatagaaccagtttccaagtctaaacaatctggtgtaatccaaagacaagaagaagttgaatacgtgcgagctctctttgactttaatggcaatgatgatgaagatcttccatttaagaaaggagacatcctgagaattcgagataagcccgaggagcagtggtggaatgctgaggacaacgatggaagacggggcatgatacctgtgccttacgtcgagaagtacaggcctccctcttcagcagggtcagccctgattggaggttggtga

SEQ ID NO: 117 - protein, 296 aa, Xenopus tropicalis
MAGNFDSEDRASWYWGKLNRQEAVNLLQGQRHGVFLVRDSTTIPGDYVLSVSENSKVSHYIINSVSNNRQSGTGMIQSRFRIGDQEFDSLPSLLEFYKIHYLDTTTLIEPVSKSKQSGVIQRQEEVEYVRALFDFNGNDDEDLPFKKGDILRIRDKPEEQWWNAEDNDGRRGMIPVPYVEKYRPPSSAGSALIGGNQENSHPQPLGGPEPGPYAQPSVNTPLPNLQNGPIFARVIQKRVPNAYDKTALALEVGDLVKVTKINVSGQWEGECNGKYGHFPFTHVRLLDQQNPEEDFS

SEQ ID NO: 118 - protein, 196 aa, Xenopus tropicalis
MAGNFDSEDRASWYWGKLNRQEAVNLLQGQRHGVFLVRDSTTIPGDYVLSVSENSKVSHYIINSVSNNRQSGTGMIQSRFRIGDQEFDSLPSLLEFYKIHYLDTTTLIEPVSKSKQSGVIQRQEEVEYVRALFDFNGNDDEDLPFKKGDILRIRDKPEEQWWNAEDNDGRRGMIPVPYVEKYRPPSSAGSALIGGW

SEQ ID NO: 119 - DNA, 195 bp, Homo sapiens
atgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggattcttcataa

SEQ ID NO: 120 - DNA, 546 bp, Homo sapiens
atgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattag

SEQ ID NO: 121 - DNA, 696 bp, Homo sapiens
atgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattag

SEQ ID NO: 122 - protein, 231 aa, Homo sapiens
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 123 - protein, 64 aa, Homo sapiens
MQDEERYMTLNVQSKKRSSAQTSQLTFKDYSVTLHWYKILLGISGTVNGILTLTLISLILLDSS

SEQ ID NO: 124 - protein, 181 aa, Homo sapiens
MQDEERYMTLNVQSKKRSSAQTSQLTFKDYSVTLHWYKILLGISGTVNGILTLTLISLILLVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 125 - DNA, 1545 bp, Homo sapiens
atggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaa

SEQ ID NO: 126 - DNA, 1422 bp, Homo sapiens
atgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaa

SEQ ID NO: 127 - DNA, 984 bp, Homo sapiens
atgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaa

SEQ ID NO: 128 - DNA, 1545 bp, Homo sapiens; identical to SEQ ID NO: 125

SEQ ID NO: 129 - protein, 514 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 130 - protein, 514 aa, Homo sapiens; identical to SEQ ID NO: 129

SEQ ID NO: 131 - protein, 327 aa, Homo sapiens
MYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 132 - protein, 473 aa, Homo sapiens
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 133 - DNA, 1476 bp, Mus musculus
atggctgaccccagcttgaatgacaaccctacagcatgccctcactgtgcatcctctcaggctggcctactgtgtgtatgtccagcaggcaagtctccagtcctggtggtggaaatgtcacagacatcgagtattggtagtacagaattttttgcttcacaagaaagaaaaaaggaaagaaataccagcagagaatcttctctaaaagatttgtccataagaacttcaaatgtggagagaaaacctcaggcacaatggagtcggagcaatgtcacagtaggaaaaatcccacacataagaatggacgatggagcaggtatcgaggaattctatacctttggaagaatattgggacaggggagctttggaatggtctttgaagctatagacaaggaaacaggagctaagtgggcaattaaaaaagtgaataaagaaaaggctggaagttctgcaatgaagctactggagcgggaggtgagcatcctgaagactgtcaaccatcaacacatcatccacctggaacaagtgtttgagtcgcctcagaaaatgtatctcgtgatggagctttgtgaggatggagaactcaaagcagttatggatcaaagagggcacttctcagagaacgagacaaggctgataattcaaagtcttgcatcagccatcgcatatcttcataacaaggatatagtgcacagagatctaaagctggaaaacataatggttaaaagcagctttatagatgataacaatgaaatgaacttaaacataaaggtgactgattttggcttgtctgtgcagaagcatggctccaggagtgaaggcatgatgcagactacatgtgggactcctatctatatggcaccagaggtcatcaatgcccatgactacagccagcagtgtgacatttggagcataggtgtcataatgttcattttactgtgtggagagccaccctttttggcaaattcagaagaaaagctctatgaattaataaaaaagggagaactacgatttgaaaatccagtctgggaatctgtaagtgattctgcaaaaaatactttgaaacaactcatgaaagtagatcctgctcacagaatcacagctaaggaacttctagataaccaatggttgacaggcaataccctttcttcagcaagaccaaccaatgtattagaaatgatgaaagaatggaaaaataacccagaaagtgatgaggagaccaacacagatgaggagactgagcagagcgctgtctacagtccatctgcaaacacagcaaagcagcccaccaatgcagccaagaagcctgctgcagagagtgttggcatgacctcttcaaactcatcgtccagcaaactcctgtctgctgaaagcaaagcagaaccagagaaaagctccgagactgtaggccatgcatcagtggctaaaaccactctgaaatccactaccttgtttcgaggcaagaaaaggctctaa

SEQ ID NO: 134 - protein, 491 aa, Mus musculus
MADPSLNDNPTACPHCASSQAGLLCVCPAGKSPVLVVEMSQTSSIGSTEFFASQERKKERNTSRESSLKDLSIRTSNVERKPQAQWSRSNVTVGKIPHIRMDDGAGIEEFYTFGRILGQGSFGMVFEAIDKETGAKWAIKKVNKEKAGSSAMKLLEREVSILKTVNHQHIIHLEQVFESPQKMYLVMELCEDGELKAVMDQRGHFSENETRLIIQSLASAIAYLHNKDIVHRDLKLENIMVKSSFIDDNNEMNLNIKVTDFGLSVQKHGSRSEGMMQTTCGTPIYMAPEVINAHDYSQQCDIWSIGVIMFILLCGEPPFLANSEEKLYELIKKGELRFENPVWESVSDSAKNTLKQLMKVDPAHRITAKELLDNQWLTGNTLSSARPTNVLEMMKEWKNNPESDEETNTDEETEQSAVYSPSANTAKQPTNAAKKPAAESVGMTSSNSSSSKLLSAESKAEPEKSSETVGHASVAKTTLKSTTLFRGKKRL

SEQ ID NO: 135 - DNA, 2961 bp, Homo sapiens
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttga

SEQ ID NO: 136 - DNA, 2964 bp, Homo sapiens
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttga

SEQ ID NO: 137 - DNA, 2787 bp, Homo sapiens
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagtgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttga

SEQ ID NO: 138 - DNA, 3168 bp, Homo sapiens
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataa

SEQ ID NO: 139 - protein, 986 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 140 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 141 - protein, 928 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEVTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 142 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 143 - DNA, 2964 bp, Mus musculus
atggccgtgcgcaggctgggggccgcgctgctgctgctgccgctgctagccgccgtggaagaaaccctgatggactctacgacagcaacggctgagctgggctggatggtacatcccccatcagggtgggaagaggtgagcggctacgacgagaacatgaacactatccgtacctaccaggtgtgcaatgtctttgagtcaagccagaacaactggctgcggaccaaattcatccggcgccgcggcgcccaccgcatccacgtggagatgaagttctcggtgcgtgactgcagcagcattcccagcgtgccgggctcctgcaaggagaccttcaacctctactactatgaggctgattttgacttagccaccaaaacctttcccaactggatggagaatccgtgggtgaaggtggacaccatcgcggccgatgagagcttctctcaggtggacctgggtggccgcgtcatgaaaatcaacactgaggtgcgaagcttcggtcccgtgtcccgcaatggtttctacctggccttccaggactatggcggctgtatgtccctcattgctgtgcgcgtcttctaccggaagtgcccccgaatcatccagaatggtgccatcttccaggagacactgtcgggggctgagagcacttcgctggtggcagctcggggcagctgcatcgccaatgctgaagaagtggatgtgcccatcaaactctactgtaacggggacggcgaatggctggtgcccataggtcgctgcatgtgcaaggcgggcttcgaggctgtggagaacggcaccgtctgccgaggttgtccatcaggaaccttcaaggccaaccaaggggacgaagcctgcacccactgtcccatcaacagccgcaccacctccgagggtgccaccaactgtgtatgccgcaacggctactacagggccgacctggaccccttagacatgccttgcacaaccatcccctctgcgccccaggctgtgatctccagcgtcaacgagacgtccctcatgctagagtggaccccaccccgagactcggggggtcgcgaggatcttgtttacaacatcatctgcaagagctgtggctccggccggggcgcatgcacgcgctgcggggacaacgtgcagtacgcgccccgccagctgggcctgactgagccgcgcatctacatcagtgacctgctggcacacacgcagtacaccttcgagatccaggccgtgaacggtgtgactgaccagagtcccttctcacctcagttcgcctctgtgaacatcaccaccaaccaagcagcaccatcggccgtgtccatcatgcaccaggtgagccgcactgtggacagcatcaccctgtcgtggtcccagccagaccagcccaacggtgtgatcctggactacgagctgcagtactatgagaagcaggagctcagtgagtacaacgccacggccataaaaagccccaccaacacagtcactgtgcagggcctcaaagccggcgccatctatgtcttccaggtgcgggcacgcaccgttgcaggctatgggcgctacagtggcaagatgtacttccaaaccatgacagaagccgagtaccagaccagcatcaaggaaaagctacccctcatcgttggctcctccgccgccggcttagtcttcctcatcgctgtggtcgtcattgccatcgtatgtaacagacgggggtttgagcgtgccgactcagagtacacggacaagctacaacactacaccagcggacacatgaccccaggcatgaagatctatatagaccctttcacctatgaagatcctaatgaggcagtgcgggagtttgccaaggaaattgacatctcctgtgtcaagattgagcaggtgatcggagcaggggaatttggtgaggtctgcagtggccatttgaagctgccaggcaagagagagatctttgtagccatcaagaccctcaagtcaggatacacggagaaacagcgccgggacttcctgagtgaggcatccatcatgggccagttcgaccaccccaatgtcatccatctggaaggggttgtcaccaagagcacacctgtcatgatcatcactgaattcatggagaacggatctctggactccttcctccggcaaaacgatgggcagttcacagtcatccaactggtgggcatgctgaggggcattgcagccggcatgaagtacctggcggacatgaactacgtgcaccgtgaccttgctgctcgaaacatcctcgtcaacagcaacctggtgtgtaaggtgtctgattttgggctctcacgcttcctggaggatgacacgtctgaccccacctataccagcgctctgggtgggaagatccccatccgttggacggcaccggaagccatccagtaccggaaattcacctcggccagtgatgtgtggagctatggcatcgtcatgtgggaggtgatgtcctacggggaacgaccctactgggacatgaccaatcaagacgtaatcaacgccattgaacaggactacagactacctccgcccatggactgccctagtgccctgcaccagctcatgctggactgctggcagaaggaccgcaaccaccggcccaagttcggccagattgtcaacacgctggacaagatgatccgaaaccccaacagcctcaaagccatggcacccctgtcctctggcatcaacctgccactgctggaccgcacgataccggactacaccagctttaacacggtggatgagtggctagaggccatcaagatgggccagtacaaggagagctttgccaacgccggctttacctctttcgacgttgtatctcagatgatgatggaggacattctccgcgttggggtcactctagctggccaccagaaaaaaatcctgaacagtatccaggtgatgcgggcccagatgaaccagatccagtctgtagaggtttga

SEQ ID NO: 144 - DNA, 2961 bp, Mus musculus
atggccgtgcgcaggctgggggccgcgctgctgctgctgccgctgctagccgccgtggaagaaaccctgatggactctacgacagcaacggctgagctgggctggatggtacatcccccatcagggtgggaagaggtgagcggctacgacgagaacatgaacactatccgtacctaccaggtgtgcaatgtctttgagtcaagccagaacaactggctgcggaccaaattcatccggcgccgcggcgcccaccgcatccacgtggagatgaagttctcggtgcgtgactgcagcagcattcccagcgtgccgggctcctgcaaggagaccttcaacctctactactatgaggctgattttgacttagccaccaaaacctttcccaactggatggagaatccgtgggtgaaggtggacaccatcgcggccgatgagagcttctctcaggtggacctgggtggccgcgtcatgaaaatcaacactgaggtgcgaagcttcggtcccgtgtcccgcaatggtttctacctggccttccaggactatggcggctgtatgtccctcattgctgtgcgcgtcttctaccggaagtgcccccgaatcatccagaatggtgccatcttccaggagacactgtcgggggctgagagcacttcgctggtggcagctcggggcagctgcatcgccaatgctgaagaagtggatgtgcccatcaaactctactgtaacggggacggcgaatggctggtgcccataggtcgctgcatgtgcaaggcgggcttcgaggctgtggagaacggcaccgtctgccgaggttgtccatcaggaaccttcaaggccaaccaaggggacgaagcctgcacccactgtcccatcaacagccgcaccacctccgagggtgccaccaactgtgtatgccgcaacggctactacagggccgacctggaccccttagacatgccttgcacaaccatcccctctgcgccccaggctgtgatctccagcgtcaacgagacgtccctcatgctagagtggaccccaccccgagactcggggggtcgcgaggatcttgtttacaacatcatctgcaagagctgtggctccggccggggcgcatgcacgcgctgcggggacaacgtgcagtacgcgccccgccagctgggcctgactgagccgcgcatctacatcagtgacctgctggcacacacgcagtacaccttcgagatccaggccgtgaacggtgtgactgaccagagtcccttctcacctcagttcgcctctgtgaacatcaccaccaaccaagcagcaccatcggccgtgtccatcatgcaccaggtgagccgcactgtggacagcatcaccctgtcgtggtcccagccagaccagcccaacggtgtgatcctggactacgagctgcagtactatgagaaggagctcagtgagtacaacgccacggccataaaaagccccaccaacacagtcactgtgcagggcctcaaagccggcgccatctatgtcttccaggtgcgggcacgcaccgttgcaggctatgggcgctacagtggcaagatgtacttccaaaccatgacagaagccgagtaccagaccagcatcaaggaaaagctacccctcatcgttggctcctccgccgccggcttagtcttcctcatcgctgtggtcgtcattgccatcgtatgtaacagacgggggtttgagcgtgccgactcagagtacacggacaagctacaacactacaccagcggacacatgaccccaggcatgaagatctatatagaccctttcacctatgaagatcctaatgaggcagtgcgggagtttgccaaggaaattgacatctcctgtgtcaagattgagcaggtgatcggagcaggggaatttggtgaggtctgcagtggccatttgaagctgccaggcaagagagagatctttgtagccatcaagaccctcaagtcaggatacacggagaaacagcgccgggacttcctgagtgaggcatccatcatgggccagttcgaccaccccaatgtcatccatctggaaggggttgtcaccaagagcacacctgtcatgatcatcactgaattcatggagaacggatctctggactccttcctccggcaaaacgatgggcagttcacagtcatccaactggtgggcatgctgaggggcattgcagccggcatgaagtacctggcggacatgaactacgtgcaccgtgaccttgctgctcgaaacatcctcgtcaacagcaacctggtgtgtaaggtgtctgattttgggctctcacgcttcctggaggatgacacgtctgaccccacctataccagcgctctgggtgggaagatccccatccgttggacggcaccggaagccatccagtaccggaaattcacctcggccagtgatgtgtggagctatggcatcgtcatgtgggaggtgatgtcctacggggaacgaccctactgggacatgaccaatcaagacgtaatcaacgccattgaacaggactacagactacctccgcccatggactgccctagtgccctgcaccagctcatgctggactgctggcagaaggaccgcaaccaccggcccaagttcggccagattgtcaacacgctggacaagatgatccgaaaccccaacagcctcaaagccatggcacccctgtcctctggcatcaacctgccactgctggaccgcacgataccggactacaccagctttaacacggtggatgagtggctagaggccatcaagatgggccagtacaaggagagctttgccaacgccggctttacctctttcgacgttgtatctcagatgatgatggaggacattctccgcgttggggtcactctagctggccaccagaaaaaaatcctgaacagtatccaggtgatgcgggcccagatgaaccagatccagtctgtagaggtttga

SEQ ID NO: 145 - protein, 987 aa, Mus musculus
MAVRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDLATKTFPNWMENPWVKVDTIAADESFSQVDLGGRVMKINTEVRSFGPVSRNGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKQELSEYNATAIKSPTNTVTVQGLKAGAIYVFQVRARTVAGYGRYSGKMYFQTMTEAEYQTSIKEKLPLIVGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 146 - protein, 986 aa, Mus musculus
MAVRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDLATKTFPNWMENPWVKVDTIAADESFSQVDLGGRVMKINTEVRSFGPVSRNGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIKEKLPLIVGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 147 - DNA, 1665 bp, Homo sapiens
atggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaa

SEQ ID NO: 148 - DNA, 1608 bp, Homo sapiens
atgttgcaaagatggtttctgccaagaagtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaa

SEQ ID NO: 149 - DNA, 1455 bp, Homo sapiens
atgttgcaaagatggtttctgccaagaagtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaa

SEQ ID NO: 150 - protein, 554 aa, Homo sapiens [sequence omitted]

SEQ ID NO: 151 - protein, 535 aa, Homo sapiens
MLQRWFLPRSLNESPGQNQKEEKLCTENFTRILDSLLDGYDNRLRPGFGGPVTEVKTDIYVTSFGPVSDVEMEYTMDVFFRQTWIDKRLKYDGPIEILRLNNMMVTKVWTPDTFFRNGKKSVSHNMTAPNKLFRIMRNGTILYTMRLTISAECPMRLVDFPMDGHACPLKFGSYAYPKSEMIYTWTKGPEKSVEVPKESSSLVQYDLIGQTVSSETIKSITGEYIVMTVYFHLRRKMGYFMIQTYIPCIMTVILSQVSFWINKESVPARTVFGITTVLTMTTLSISARHSLPKVSYATAMDWFIAVCFAFVFSALIEFAAVNYFTNIQMEKAKRKTSKPPQEVPAAPVQREKHPEAPLQNTNANLNMRKRTNALVHSESDVGNRTEVGNHSSKSSTVVQESSKGTPRSYLASSPNPFSRANAAETISAARALPSASPTSIRTGYMPRKASVGSASTRHVFGSRLQRIKTTVNTIGATGKLSATPPPSAPPPSGSGTSKIDKYARILFPVTFGAFNMVYWVVYLSKDTMEKSESLM

SEQ ID NO: 152 - protein, 484 aa, Homo sapiens
MLQRWFLPRSLNESPGQNQKEEKLCTENFTRILDSLLDGYDNRLRPGFGGPVTEVKTDIYVTSFGPVSDVEMEYTMDVFFRQTWIDKRLKYDGPIEILRLNNMMVTKVWTPDTFFRNGKKSVSHNMTAPNKLFRIMRNGTILYTMRLTISAECPMRLVDFPMDGHACPLKFGSYAYPKSEMIYTWTKGPEKSVEVPKESSSLVQYDLIGQTVSSETIKSITGITTVLTMTTLSISARHSLPKVSYATAMDWFIAVCFAFVFSALIEFAAVNYFTNIQMEKAKRKTSKPPQEVPAAPVQREKHPEAPLQNTNANLNMRKRTNALVHSESDVGNRTEVGNHSSKSSTVVQESSKGTPRSYLASSPNPFSRANAAETISAARALPSASPTSIRTGYMPRKASVGSASTRHVFGSRLQRIKTTVNTIGATGKLSATPPPSAPPPSGSGTSKIDKYARILFPVTFGAFNMVYWVVYLSKDTMEKSESLM

SEQ ID NO: 153 - DNA, 1659 bp, Mus musculus
atggtttctgtccagaaggtacccgcgattgcgctgtgctccggggtcagcctcgccctcctgcacttcctgtgcctggcggcttgtttaaacgaatccccaggacagaactcaaaggacgagaaattgtgcccggaaaattttacccgtattctggacagtttgctggatggttatgacaacaggctgcgtcctggatttgggggtcctgttacagaagtgaaaactgatatatatgtcaccagctttgggcccgtttctgatgttgaaatggaatacactatggatgtgttcttcagacagacatggattgacaaaagactaaaatatgacggcccaattgaaatcttgaggctgaataatatgatggtcaccaaagtttggacccctgatactttcttcaggaatggaaagaaatctgtctcacataacatgacagctccaaataagctttttagaattatgagaaatggcactattttatacacaatgagactcaccataagtgcggagtgccccatgagactggtggattttcctatggatggtcatgcctgccctttgaaatttgggagttatgcatatcccaaaagtgagatgatctacacctggaccaaaggccctgagaagtcagtggaggtgccaaaggagtcttctagcttagttcaatatgacctcattgggcagactgtatcaagcgagactatcaaatctattacaggtgaatacattgttatgacggtttacttccacctcagacggaagatgggctactttatgattcagacgtatatcccatgcatcatgacagtgattctttctcaagtttccttctggataaacaaggagtctgttccagctagaactgtatttggaataaccacagtcctcacgatgaccaccctaagcatcagtgctcggcattctttgcccaaagtgtcctatgcgactgccatggattggttcatagctgtctgttttgcttttgtattttcggctcttattgagtttgctgctgtcaactatttcaccaacattcaaatgcagaaagccaaaaagaagatatcaaagcctcccccagaagttccagctgctcctgtgctgaaggagaaacacacagaaacatcccttcagaatacacatgccaatttgaacatgaggaaaagaacaaatgccttggtccattcagaatcggatgtcaaaagcagaactgaggtgggaaatcactccagcaagaccagcgctgtccaggagtcttctgaagccacgcctaaggctcacttagcttccagtccaaatccattcagcagggcaaatgcagctgagactatgtctgctgcagccagaggtctttcatctgcagcatccccctctcctcatggcacattgcggccagcttctttggggtcagcttccactcgccctgcatttggatctagacttgggcgaattaagacaacagttaatacaacaggggctgctgggaatgtgtcagccacacctcctccccctgctccaccgccttctggatctggcacaagtaaaatagacaaatatgctcgtattctctttccagtcacatttggagcatttaacatggtctactgggttgtttatttatctaaggacaccatggagaaatcagaaagtctaatgtaa

SEQ ID NO: 154 - protein, 552 aa, Mus musculus
MVSVQKVPAIALCSGVSLALLHFLCLAACLNESPGQNSKDEKLCPENFTRILDSLLDGYDNRLRPGFGGPVTEVKTDIYVTSFGPVSDVEMEYTMDVFFRQTWIDKRLKYDGPIEILRLNNMMVTKVWTPDTFFRNGKKSVSHNMTAPNKLFRIMRNGTILYTMRLTISAECPMRLVDFPMDGHACPLKFGSYAYPKSEMIYTWTKGPEKSVEVPKESSSLVQYDLIGQTVSSETIKSITGEYIVMTVYFHLRRKMGYFMIQTYIPCIMTVILSQVSFWINKESVPARTVFGITTVLTMTTLSISARHSLPKVSYATAMDWFIAVCFAFVFSALIEFAAVNYFTNIQMQKAKKKISKPPPEVPAAPVLKEKHTETSLQNTHANLNMRKRTNALVHSESDVKSRTEVGNHSSKTSAVQESSEATPKAHLASSPNPFSRANAAETMSAAARGLSSAASPSPHGTLRPASLGSASTRPAFGSRLGRIKTTVNTTGAAGNVSATPPPPAPPPSGSGTSKIDKYARILFPVTFGAFNMVYWVVYLSKDTMEKSESLM

SEQ ID NO: 155 - DNA, 1440 bp, Homo sapiens
atggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtag

SEQ ID NO: 156 - protein, 479 aa, Homo sapiens
MDETSPLVSPERAQPPDYTFPSGSGAHFPQVPGGAVRVAAAAGSGPSPPGSPGHDRERQPLLDRARGAAAQGQTQTVAAQAQALAAQAAAAAHAAQAHRERNEFPEDPEFEAVVRQAELAIERCIFPERIYQGSSGSYFVKDPQGRIIAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDSSSSRDTDWVVVKEPVIKVAAIDNGLAFPLKHPDSWRAYPFYWAWLPQAKVPFSQEIKDLILPKISDPNFVKDLEEDLYELFKKDPGFDRGQFHKQIAVMRGQILNLTQALKDNKSPLHLVQMPPVIVETARSHQRSSSESYTQSFQSRKPFFSWW

SEQ ID NO: 157 - DNA, 1440 bp, Mus musculus
atggacgagacgagcccgctagtgtcccccgagcgggcccaacccccggagtacaccttcccgtcgggctccggagctcactttccgcaagtaccggggggcgcggtccgcgtggcggcggcggccggctccggcccgtcaccgccgtgctcgcccggccacgaccgggagcggcagcccctgctggaccgggcccggggcgcggcggcgcagggccagacccacacggtggcggtgcaggcccaggccctggccgcccaagcggccgtggcggcgcacgccgttcagacccaccgcgagcggaacgacttcccggaggaccccgagttcgaggtggtggtgcggcaggccgaggttgccatcgagtgcagcatctatcccgagcgcatctaccagggctccagtggaagctacttcgtcaaggactctcaggggagaatcgttgctgtcttcaaacccaagaatgaagagccatacgggcaccttaaccctaagtggaccaagtggctgcagaagctgtgctgcccctgctgctttggccgagactgccttgttctcaaccagggctatctctcagaggcaggggctagcctggtggaccaaaaactggaactcaacattgtaccacgtacaaaggtagtatacctggccagtgaaaccttcaactacagtgccattgatcgagtaaagtccaggggcaagcggcttgcactagagaaagtgccaaaagttgggcagcggtttaaccgaatcggcctgccaccaaaggtcgggtcattccagctcttcgttgaaggctacaaagatgcagactattggctgcggcgttttgaagcagaacctctccctgagaacacgaaccgacagctgctattgcagtttgagcggttggtggtcctggactacatcatccgcaacactgaccgaggcaatgacaactggttgatcaaatatgactgtccgatggataattctagctgtcgggacacagattgggtgatggtgagggagcctgttatcaaggtggctgccatagacaacgggctagctttcccactgaagcatcctgactcctggagggcatatcctttttactgggcctggctgcctcaggcgaaagtcccgttctctcaggagatcaaagatttgattcttccaaagatttcagaccctaacttcatcaaggacttggaggaggacctatatgaactcttcaagagagatcctggcttcgacaggggccagttccataagcagattgctgtcatgagaggccagatcctaaatttgacccaggccctgaaagacaataagagccccctgcacctcgtccagatgccacctgtgattgtcgagacggcccgctctcaccagcggtctgcaagcgaatcctacacacagagctttcagagtcggaagcccttcttttcatggtggtag

SEQ ID NO: 158 - protein, 479 aa, Mus musculus
MDETSPLVSPERAQPPEYTFPSGSGAHFPQVPGGAVRVAAAAGSGPSPPCSPGHDRERQPLLDRARGAAAQGQTHTVAVQAQALAAQAAVAAHAVQTHRERNDFPEDPEFEVVVRQAEVAIECSIYPERIYQGSSGSYFVKDSQGRIVAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDNSSCRDTDWVMVREPVIKVAAIDNGLAFPLKHPDSWRAYPFYWAWLPQAKVPFSQEIKDLILPKISDPNFIKDLEEDLYELFKRDPGFDRGQFHKQIAVMRGQILNLTQALKDNKSPLHLVQMPPVIVETARSHQRSASESYTQSFQSRKPFFSWW

SEQ ID NO: 159 - DNA, 2187 bp, Homo sapiens
atggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctga

SEQ ID NO: 160 - protein, 728 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 161 - DNA, 2169 bp, Mus musculus
atggcaggagccgagggcttccagtacagggctgtgtacccattccgccgggagcggcctgaagacctggagctgctccctggggacctcctggtggtgagccgggtggccctacaggcacttggtgtggctgatggaggagagcgctgcccacacaatgtgggctggatgcctggcttcaacgagcgcacccgacagcgaggggacttccccgggacatacgtggagttcctaggacccgtggctctggctcgaccaggccctcgcccacgggggccccgtccgttgcccgccaggcccttggatggatcttctgagtcaggccacatactcccagacctggcagagcagttctccccacctgaccctgctcccccgattctggtgaagctggtggaagccattgagcaagcagagctggacagtgaatgctacagtaagccggagctgcccgcaacacggacagactggtccctgagtgacttggagcagtgggaccgcaccgccttgtatgatgctgttaagggcttcctgctggcgttgcctgcagctgtggtgacccctgaagctgcagcagaggcgtaccgggcacttcgagaggttgcaggccccgtggggctggtgctggaacccccaacactgccgctgcaccaggctctcacactgcgtttcctgctgcaacacctgggtcgtgtggcccgcagagcaccctcgccagatacagctgtccatgcactggccagtgccttcgggccgctactgctgcgcatacctccgtcagggggcgagggtgatgggagtgagcctgtacccgacttccctgtgctgctgctagagaggctggtgcaggagcatgtggaggagcaagacgctgcccccccagcgctaccacctaagccctctaaggcaaagccggcacccacagctctggccaatggagggagcccgccctcgcttcaggatgcagagtggtactggggggacatctccagggaagaggtgaatgagagactccgggacacacctgatggtaccttcttagtcagagatgcatccagcaagatccaaggagagtacacgctcaccctcaggaaaggcgggaacaacaagttgatcaaagtcttccaccgggatggtcactatggcttctcagagccccttaccttctgctccgtggtggaactcatctcccactaccgccacgaatcactggcccagtacaacgccaagctggacacacgccttctctaccctgtgtccaagtaccaacaagaccaggtggtgaaggaggacagcatagaggctgtgggcgcccagctcaaggtctaccaccagcagtaccaggacaagagccgcgaatatgaccagctgtatgaagaatacacacggacctcccaggagctgcagatgaagcgcacagccatagaggccttcaacgagaccatcaagatcttcgaagagcagggccagacacaggagaaatgcagcaaggagtatttggagcgcttccggcgagagggaaatgagaaggagatgcagaggatcctgctgaactccgagcgactcaagtctcgcatcgcggagatacacgaaagccgcacgaagttggagcaggatctgcgggcgcaggcctccgacaaccgtgagatcgacaagcgcatgaacagcctcaaacctgacctcatgcagctgcgcaagatcagggaccagtacctcgtgtggctcacccagaaaggtgcccgacagaggaagatcaacgaatggctgggaatcaagaacgagactgaggaccagtattcactgatggaggatgaggacgccctcccccaccacgaggagcgcacgtggtacgtgggcaagatcaaccgcacacaggcggaggagatgctgagtggcaaacgagacgggaccttcctcatccgggagagcagccagcggggctgttacgcatgctccgtggtggtggacggcgacacgaagcactgtgtcatctaccgcacagccaccggcttcggcttcgcagagccctataacctgtacgggtccctgaaggagctggtgctgcactaccagcacgcatcactcgtgcagcacaatgacgcacttaccgtcaccctcgcacaccctgtgcgtgcccccgggcctggcccaccgtctgcagcacgctga

SEQ ID NO: 162 - protein, 722 aa, Mus musculus
MAGAEGFQYRAVYPFRRERPEDLELLPGDLLVVSRVALQALGVADGGERCPHNVGWMPGFNERTRQRGDFPGTYVEFLGPVALARPGPRPRGPRPLPARPLDGSSESGHILPDLAEQFSPPDPAPPILVKLVEAIEQAELDSECYSKPELPATRTDWSLSDLEQWDRTALYDAVKGFLLALPAAVVTPEAAAEAYRALREVAGPVGLVLEPPTLPLHQALTLRFLLQHLGRVARRAPSPDTAVHALASAFGPLLLRIPPSGGEGDGSEPVPDFPVLLLERLVQEHVEEQDAAPPALPPKPSKAKPAPTALANGGSPPSLQDAEWYWGDISREEVNERLRDTPDGTFLVRDASSKIQGEYTLTLRKGGNNKLIKVFHRDGHYGFSEPLTFCSVVELISHYRHESLAQYNAKLDTRLLYPVSKYQQDQVVKEDSIEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQDLRAQASDNREIDKRMNSLKPDLMQLRKIRDQYLVWLTQKGARQRKINEWLGIKNETEDQYSLMEDEDALPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPSAAR

SEQ ID NO: 163 - DNA, 1449 bp, Homo sapiens
atggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagggtgacatggtagatctgccacgccccagctgcgtgactttgggagttcctttgttttctcatctgcagaatgagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatga

SEQ ID NO: 164 - DNA, 1374 bp, Homo sapiens
atggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatga

SEQ ID NO: 165 - protein, 482 aa, Homo sapiens
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 166 - protein, 457 aa, Homo sapiens
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 167 - DNA, 1374 bp, Mus musculus
atggagctctcgactgttctcctgctgctaggcctctgctccgctggccttgttctgggctccgaacatgagacgcgtctggtggcaaagctctttgaagactacagcagtgtagtccggccagtggaggaccaccgtgagattgtacaagtcaccgtgggtctacagctgatccagcttatcaatgtggatgaagtaaatcagattgtgacaaccaatgtacgtctgaaacagcaatgggtcgattacaacttgaaatggaatccagatgactatggaggagtgaaaaaaattcacatcccctcggaaaagatctggcggccggacgtcgttctctataacaacgcagacggcgactttgccattgtcaaattcaccaaggtgctcctggactacaccggccacatcacctggacaccgccagccatctttaaaagctactgtgagatcattgtcactcactttcccttcgatgagcagaactgcagcatgaagctgggcacctggacctatgacggctctgtggtggccattaacccggaaagtgaccagcccgacctgagtaacttcatggagagcggggagtgggtgatcaaggaagctcggggctggaagcactgggtgttctactcctgctgccccaccactccctacctggacatcacctaccacttcgtcatgcagcgcctgcccctctacttcattgtcaacgtcatcattccctgcctgctcttctccttcttaaccagcctggtgttctacctgcccacagactcaggggagaagatgacgctgagcatctctgtcttactgtccctgaccgtgttccttctggtcattgtggagctaatcccttccacctccagcgctgtgcccctgatcgggaagtatatgttgttcaccatggtctttgtcattgcgtccatcatcatcaccgtcatcgtcatcaacacacaccaccgttcgcccagcacccacatcatgcccgagtgggtgcggaaggtttttatcgacactatcccaaacatcatgtttttctccacaatgaaaagaccatccagagataaacaagagaaaaggatttttacagaagacatagatatatctgacatctctgggaagccgggtcctccacctatgggctttcactctccgctgatcaagcaccctgaggtgaaaagcgccatcgagggcgtgaagtacattgcagagaccatgaagtcagaccaggagtccaataacgccgctgaggaatggaagtatgttgccatggtgatggatcacatcctcctcggagtctttatgctggtgtgtctcatcgggacgctggctgtgtttgcaggtcggctcattgagttacatcaacaaggatga

SEQ ID NO: 168 - protein, 457 aa, Mus musculus
MELSTVLLLLGLCSAGLVLGSEHETRLVAKLFEDYSSVVRPVEDHREIVQVTVGLQLIQLINVDEVNQIVTTNVRLKQQWVDYNLKWNPDDYGGVKKIHIPSEKIWRPDVVLYNNADGDFAIVKFTKVLLDYTGHITWTPPAIFKSYCEIIVTHFPFDEQNCSMKLGTWTYDGSVVAINPESDQPDLSNFMESGEWVIKEARGWKHWVFYSCCPTTPYLDITYHFVMQRLPLYFIVNVIIPCLLFSFLTSLVFYLPTDSGEKMTLSISVLLSLTVFLLVIVELIPSTSSAVPLIGKYMLFTMVFVIASIIITVIVINTHHRSPSTHIMPEWVRKVFIDTIPNIMFFSTMKRPSRDKQEKRIFTEDIDISDISGKPGPPPMGFHSPLIKHPEVKSAIEGVKYIAETMKSDQESNNAAEEWKYVAMVMDHILLGVFMLVCLIGTLAVFAGRLIELHQQG

SEQ ID NO: 169 - DNA, 1548 bp, Homo sapiens
atggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactga

SEQ ID NO: 170 - protein, 515 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 171 - DNA, 1554 bp, Mus musculus
atggcggcgcccagggggcccgggctgttcctcatacccgcgctgctcggcttactcggggtggcgtggtgcagcctaagcttcggggtttcccgcgacgatgacctgctgctgccttacccactagcgcgcagacgtccctcgcgagactgcgcccgggtgcgctcaggtagcccagagcaggagagctggcctccgccacccacgaaccccggcgccagccaccacgcggccgtgcgcaccttcgtgtcgcacttcgaggggcgcgcggtggccggccacctgacgcgggtcgccgatcccctacgcactttctcggtgctggagcccggaggagccgggggctgcgcgcagaagcgccgcgctactgtggaggacacagccgtcccggccggttgccgcatcgctcagaacggtggcttcttccgcatgagcactggcgagtgcttggggaacgtggtgagcgacgggcggctggtgagcagctcagggggactgcagaacgcgcagttcggtatccgacgcgatggaaccatagtcaccgggtacctgtctgaggaggaggttctggatcccgtgaatccgttcgtgcagctgctgagcggagtcgtgtggctcatccgcaatggaaacatctacatcaacgagagccaagccatcgagtgtgacgagacacaggagacaggttcttttagcaaatttgtgaatgtgatgtcagccaggacagccgtgggtcatgaccgtgaggggcagcttatcctcttccatgctgatggacagacggaacagcgtggccttaacctatgggagatggcagagttcctgcgtcaacaagatgtcgtcaatgccatcaacctggatggaggcggttctgctacttttgtgctcaatgggaccctggccagttacccttcagatcactgccaggacaacatgtggcgctgtccccgccaagtgtccactgtggtgtgtgtgcatgaaccgcgctgccagccacccgactgcagtggccatgggacctgtgtggatggccactgtgaatgcaccagccacttctggcggggcgaggcctgcagcgagctggactgtggcccctccaactgcagccagcatgggctgtgcacagagactggctgccactgtgatgctgggtggacaggatccaactgcagtgaagagtgtcctctgggctggtatgggccaggttgccagaggccctgccagtgtgagcaccagtgttcctgtgacccgcagactggcaactgcagcatctcccaagtgaggcagtgtctccagccaactgaggctacgccgagggcaggagagctggcctctttcaccaggaccacctggctagccctcaccctgacactaattttcctgctgctgatcagcactggggtcaacgtgtccttgttcctgggctccagggccgagaggaaccggcacctcgacggggactatgtgtatcacccactgcaggaggtgaacggggaagcgctgactgcagagaaggagcacatggaggaaactagcaaccccttcaaggactga

SEQ ID NO: 172 - protein, 517 aa, Mus musculus
MAAPRGPGLFLIPALLGLLGVAWCSLSFGVSRDDDLLLPYPLARRRPSRDCARVRSGSPEQESWPPPPTNPGASHHAAVRTFVSHFEGRAVAGHLTRVADPLRTFSVLEPGGAGGCAQKRRATVEDTAVPAGCRIAQNGGFFRMSTGECLGNVVSDGRLVSSSGGLQNAQFGIRRDGTIVTGYLSEEEVLDPVNPFVQLLSGVVWLIRNGNIYINESQAIECDETQETGSFSKFVNVMSARTAVGHDREGQLILFHADGQTEQRGLNLWEMAEFLRQQDVVNAINLDGGGSATFVLNGTLASYPSDHCQDNMWRCPRQVSTVVCVHEPRCQPPDCSGHGTCVDGHCECTSHFWRGEACSELDCGPSNCSQHGLCTETGCHCDAGWTGSNCSEECPLGWYGPGCQRPCQCEHQCSCDPQTGNCSISQVRQCLQPTEATPRAGELASFTRTTWLALTLTLIFLLLISTGVNVSLFLGSRAERNRHLDGDYVYHPLQEVNGEALTAEKEHMEETSNPFKD

SEQ ID NO: 173 - DNA, 2364 bp, Homo sapiens
atggagcctgcaggggagcgctttcccgaacaaaggcaagtcctgattctccttcttttactggaagtgactctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagctgtgtggccctactgagccctgtataatgcatttccaagtgttactgaaaaaacctttggaagtatttcgagctgaactactagtgacagacataaacgatcattctcctgagtttcctgaaagagaaatgaccctgaaaatcccagaaactagctcccttgggactgtgtttcctctgaaaaaagctcgggacttggacgtgggcagcaataatgttcaaaactacaatatttctcccaattctcatttccatgtttccactcgcacccgaggggatggcaggaaatacccagagctggtgctggacacagaactggatcgcgaggagcaggccgagctcagattaaccttgacagcggtggacggtggctctccaccccgatctggcaccgtccagatcctcatcttggtcttggacgccaatgacaatgccccggagtttgtgcaggcgctctacgaggtgcaggtcccagagaacagcccagtaggctccctagttgtcaaggtctctgctagggatttagacactgggacaaatggagagatatcatactccctttattacagctctcaggagatagacaaaccttttgagctaagcagcctttcaggagaaattcgactaattaaaaaactagattttgagacaatgtcttcgtatgatctagatatagaggcatctgatggcgggggactttctggaaaatgctctgtctctgttaaggtgctggatgttaacgataacttcccggaactaagtatttcatcacttaccagccctattcccgagaattctccagagacagaagtggccctgtttaggattagagaccgagactctggggaaaatggaaaaatgatttgctcaattcaggatgatgttccttttaagctaaaaccttctgttgagaatttctacaggctggtaacagaaggggcgctggacagagagaccagagccgagtacaacatcaccatcaccatcacagacttggggactccaaggctgaaaaccgagcagagcataaccgtgctggtgtcggacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccgggacccgcacctgcccctcacctccctggtctccattaacacggacaacggccacctgttcgctctccagtcgctggactacgaggccctgcaggctttcgagttccgcgtgggcgccacagaccgcggcttcccggcgctgagcagcgaggcgctggtgcgagtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgtggccaagcacaggctagtggtgctggtcaaggacaatggcgagcctccgcgctcggccaccgccacgctgcaagtgctcctggtggacggcttctctcagccctacctgccgctcccagaggcggccccggcccaagcccaggccgactcgcttaccgtctacctggtggtggcattggcctcggtgtcttcgctcttcctcttctcggtgttcctgttcgtggcagtgcggctgtgcaggaggagcagggcggcctcagtgggtcgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataa

SEQ ID NO: 174 - protein, 787 aa, Homo sapiens
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYLVVALASVSSLFLFSVFLFVAVRLCRRSRAASVGRCSVPEGPFPGHLVDVSGTGTLSQSYQYEVCLTGGSESNDFKFLKPIFPNIVSQDSRRKSEFLE

SEQ ID NO: 175 - DNA, 2385 bp, Mus musculus
atgaagattggaagggaacacagaaaaaggcaagttctgttgatctttctcttgctgggagtggttggggcgggctcggaaccccgccgctactttgtgatggaggaaacacccagtggcactgttttggcagatctagtccaggacctagggctgggagttgcggagctagctgctcgaggagcccaggtagtctctgaggaaaaggaatcccgcttgcagctggatctacagactgggaagctaatcttaaatgaaaaactggaccgcgaggagctgtgcggctccactgagccctgtgtcactcatttccaagtgttactgaaaaaaccactggaaatatttcaagctgagctacgagtaggagacattaatgatcattctcctgagtttcctgaaagagaaatggccgtgaaaatcatagagaatagccctgttggcactgcgtttctactcaaaacagctcaggatttggatgtgggaaataacagcgttcagaactataagattggtaccaattctcatttccatgtttccatccgcaaccgaggtgatggaagaaaatacccagagctggtgctggacaaggagctcgatcgcgaggtgcaggcagcgttcagattaactctgacagcgctagatggcggttctccgcccaggactggcacctcgcaaatccgcattgttgtcttggatgtcaatgacaatgcccctgagtttgcacaggctttctaccgggtgcaaattccagagaacagtccctcgggttccatggttgctaaggtctctgctaaggatttagacactgggacaaatggagaggtatcatactctctttttcacagttctcaggaaatgagcaaaacttttgagctaaacgccctgtcaggagaagttcgactaatcaaaacactggactttgagacaacaccttcatatgaactagacatagaggcaactgatggcgggggtctttctggaaaatgctctgtttctattcaggtggtggatgtcaacgataattacccagaactaattatatcatcgctcaccaatccaatcccagaaaattcaccagagacagaggtggctctgtttcggattcgagaccgagactctggagagaatggaaggacaatttgttccatccaggatggtgttccctttacactggaaccttccgttgagaacttctatagactggtgacagatggagctctggacagagagatcagagctgagtacaacattactatctccgtcaccgacctgggcatacccaagctcacaacccagcacaccataacagtgcaggtgtccgacatcaacgacaatgcccccgcctttacccaagtctcctacaccatgctcgtccacgagaacaacagcccagccctgcacataggcaccatcagcgccacagactcagactcaggctccaatgcccacatcacctactcgttgctgccggcccaggagccacagctggccctcaactcactcatctccatcaacgctgacaacgggcagctgttcgcgctcagggcgctggactacgaggccctgcaggccttcgagttccacgtgagtgccacagaccgaggctcaccagcgctcagcagccaggctctggtgcgcatagtggtgctggacgacaatgacaatgcgcccttcgtgctctacccgatgcagaatgcctctgcgccctgcacagagctgctgcccagggcggcagagcccggctacctggtcaccaaggtggtggctgtggatcgcgactctggccagaatgcctggctgtcgttccagctgctcaaggctacagagcccgggttgttcagcgtgtgggcgcacaatggtgaggtgcgcaccaccaggctgttgagtgagcgagatgtacccaagcacaggctgctgctggtggtcaaggacaatggagagcctccgcgctctgctagcgtcacactgcaggtgctaatggtggatggcttctctcagccctacctgcctctgccagaggtggtgcgcgaccccagtcaccaggaaggtgatgtgctcacgctgtacctggtcatagccttggcttctgtgtcttctctcttcctcttgtctgtgctgctgtttgtgggggtgaggctgtgcaggagggccagggaggtctctctgggtggctgctctgtgcctgagggacactttcctggccacctggtggatgtcagcggggcagggaccctgtctcagagctaccagtatgaggtgtgtcttacaggagattctcagagtaatgagttcaaattcttgaagcctgtgttttctggtattgtagaccaaaactatggtaggcaaccagatgatcagtccttctcaagtgttttaggtatgtga

SEQ ID NO: 176 - protein, 794 aa, Mus musculus
MKIGREHRKRQVLLIFLLLGVVGAGSEPRRYFVMEETPSGTVLADLVQDLGLGVAELAARGAQVVSEEKESRLQLDLQTGKLILNEKLDREELCGSTEPCVTHFQVLLKKPLEIFQAELRVGDINDHSPEFPEREMAVKIIENSPVGTAFLLKTAQDLDVGNNSVQNYKIGTNSHFHVSIRNRGDGRKYPELVLDKELDREVQAAFRLTLTALDGGSPPRTGTSQIRIVVLDVNDNAPEFAQAFYRVQIPENSPSGSMVAKVSAKDLDTGTNGEVSYSLFHSSQEMSKTFELNALSGEVRLIKTLDFETTPSYELDIEATDGGGLSGKCSVSIQVVDVNDNYPELIISSLTNPIPENSPETEVALFRIRDRDSGENGRTICSIQDGVPFTLEPSVENFYRLVTDGALDREIRAEYNITISVTDLGIPKLTTQHTITVQVSDINDNAPAFTQVSYTMLVHENNSPALHIGTISATDSDSGSNAHITYSLLPAQEPQLALNSLISINADNGQLFALRALDYEALQAFEFHVSATDRGSPALSSQALVRIVVLDDNDNAPFVLYPMQNASAPCTELLPRAAEPGYLVTKVVAVDRDSGQNAWLSFQLLKATEPGLFSVWAHNGEVRTTRLLSERDVPKHRLLLVVKDNGEPPRSASVTLQVLMVDGFSQPYLPLPEVVRDPSHQEGDVLTLYLVIALASVSSLFLLSVLLFVGVRLCRRAREVSLGGCSVPEGHFPGHLVDVSGAGTLSQSYQYEVCLTGDSQSNEFKFLKPVFSGIVDQNYGRQPDDQSFSSVLGM

SEQ ID NO: 177 - DNA, 930 bp, Homo sapiens
atggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaa

SEQ ID NO: 178 - DNA, 846 bp, Homo sapiens
atggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgagttcagcatgaggcagtaa

SEQ ID NO: 179 - protein, 309 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 180 - protein, 281 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGEFSMRQ

SEQ ID NO: 181 - DNA, 933 bp, Mus musculus
atggcctcggagttacagcgtccggactccatgccctgtcacaatcggcaagtaaactctacttctagcccaagtcccgagcatctgctagccgaggaccgggtcctggatcatgcagaggaaaataacgctgctatggctaagctgactctcctccctgggcacgcccattctagcgtgctttcggagcgggactctccggcctgctgcagcactaatcttcactctgagaaccacagtgacagtagtgacagtggcaactacgatgcacctgtcggcggcgactccctgctaggggactgtgaactctcccgacagattggggctcagcttaagttgctgcctatgaatgatcagatccgggagcttcagactatcatccgggacaagacagccagtagaggggacttcatgttttctgcagatcgcttgatcagacttgttgtagaagagggactgaatcagctgccatataaagaatgtatggtgaccactccgacagggcacaagtatgaaggagtgaaatttgagaaaggaaattgtggggtcagcataatgagaagtggtgaggcaatggaacaaggtttgcgagactgctgtcgatccatacggattgggaagatcctgattcagagtgatgaggagacacaaagggccaaagtatattatgccaagttccccccagacattcatcgcagaaaagtccttctgatgtatccaattctcagtactggaaatactgtaattgaagctgtaaaggttcttatagaacatggtgttcaacccagtgttattatcctactcagtctcttctccaccccacatggtgccaaatcaatcattcaagaatttccagagatcacaattttaactacagaagtccatcctgttgcacctacacattttggacagaaatactttggaacagactaa

SEQ ID NO: 182 - protein, 310 aa, Mus musculus
MASELQRPDSMPCHNRQVNSTSSPSPEHLLAEDRVLDHAEENNAAMAKLTLLPGHAHSSVLSERDSPACCSTNLHSENHSDSSDSGNYDAPVGGDSLLGDCELSRQIGAQLKLLPMNDQIRELQTIIRDKTASRGDFMFSADRLIRLVVEEGLNQLPYKECMVTTPTGHKYEGVKFEKGNCGVSIMRSGEAMEQGLRDCCRSIRIGKILIQSDEETQRAKVYYAKFPPDIHRRKVLLMYPILSTGNTVIEAVKVLIEHGVQPSVIILLSLFSTPHGAKSIIQEFPEITILTTEVHPVAPTHFGQKYFGTD

SEQ ID NO: 183 - DNA, 2817 bp, Homo sapiens
atgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctga

SEQ ID NO: 184 - DNA, 2706 bp, Homo sapiens
atgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagagcaccgggggtggacgcggcgctttgcaaaaccaaaaagacacagtgctgccgcgacgcgctattgagagggaggagggccagctgcagctgtgttcccgtcatagggagagctga

SEQ ID NO: 185 - DNA, 2832 bp, Homo sapiens
atgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtga

SEQ ID NO: 186 - DNA, 2658 bp, Homo sapiens
atgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagcagtaccatcccactgatatcacgggcccgctcaacctctcagatccctcggtcagcaccgtggtgtga

SEQ ID NO: 187 - DNA, 2721 bp, Homo sapiens
atgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagcagtaccatcccactgatatcacgggcccgctcaacctctcagatccctcggtcagcaccgtggtgtga

SEQ ID NO: 188 - protein, 938 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 189 - protein, 901 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQSTGGGRGALQNQKDTVLPRRAIEREEGQLQLCSRHRES

SEQ ID NO: 190 - protein, 943 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 191 - protein, 885 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 192 - protein, 906 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 193 - DNA, 1518 bp, Homo sapiens
atgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatga

SEQ ID NO: 194 - protein, 505 aa, Homo sapiens
MSNICQRLWEYLEPYLPCLSTEADKSTVIENPGALCSPQSQRHGHYFVALFDYQARTAEDLSFRAGDKLQVLDTLHEGWWFARHLEKRRDGSSQQLQGYIPSNYVAEDRSLQAEPWFFGAIGRSDAEKQLLYSENKTGSFLIRESESQKGEFSLSVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 195 - DNA, 1539 bp, Mus musculus
atgggcagcgtctgtgtgagactctgggcatacctgcagccttttctcccgtgctggtctcaagaggcagacaagtcagtagtaattgagaatccaggggccttctgtcccccagaggctcccaggtcacaagagcccgagagaagccatggccagtattttgtggctctgtttgattaccaagcacgtactgcagaggacctgagcttccgtgccggcgacaaactccaagtcttggacacttcgcatgagggctggtggttggccagacatttggagaagaagggaaccggcttaggtcagcagctacagggctacattccttccaattacgtggcggaggaccggagtctccaggcagagccgtggttttttggagcaatcaaaagagcagatgcagaaaaacaacttctgtattcagaaaaccagacgggcgcctttctaatcagagagagtgagagccagaagggtgacttttccctctcagttttagatgaaggtgttgtaaaacactacagaataagaaggttggatgaaggtggcttcttcctcaccaggaggaaagtcttttcaaccctgaatgaattcgtgaactactacaccacaacaagtgacgggctgtgtgtcaagctggagaagccatgcttaaagatccaggtaccaaccccttttgatttgtcatataaaactgcagaccagtgggagatagaccgcaactccatacagcttttgaagcgactgggatctggtcagtttggagaagtttgggaaggtctgtggaataataccactccagtggccgtaaaaacgttaaaaccaggttcaatggatccaaatgacttcctgagggaggcacagataatgaagagcctaagacacccaaaactcatccagctctatgctgtttgcactttagaagatcccatttatattattacagagttgatgagacatggaagcctgcaagaatatctccaaaatgatggtgggtcaaaaatccatttgattcaacaggtagacatggcggcacaggtggcttctggaatggcctatcttgagtcgcagaactatattcacagagatctggctgcaagaaatgtccttgttggtgaacataatatctacaaagtagcagattttggacttgcaagagtttttaaggtagataatgaagacatctatgaatctaaacacgaaataaagctgccagtgaagtggactgcacccgaagccattcgtactaataaattcagcattaagtctgatgtgtggtcttttggaatcctgctctatgaaatcattacttatggcaaaatgccttacagtggtatgacaggtgctcaagtaattcaaatgttgagtcaaaactacagacttccacagccatctaactgcccacagcaattctacagcatcatgctagagtgctggaatgttgagcctaagcaacggccaacatttgagaccctgcattggaaacttgaagactactttgaaacagactgttcctattcagatacaaataacttcataaactaa

SEQ ID NO: 196 - DNA, 1539 bp, Mus musculus; identical to SEQ ID NO: 195

SEQ ID NO: 197 - protein, 512 aa, Mus musculus
MGSVCVRLWAYLQPFLPCWSQEADKSVVIENPGAFCPPEAPRSQEPERSHGQYFVALFDYQARTAEDLSFRAGDKLQVLDTSHEGWWLARHLEKKGTGLGQQLQGYIPSNYVAEDRSLQAEPWFFGAIKRADAEKQLLYSENQTGAFLIRESESQKGDFSLSVLDEGVVKHYRIRRLDEGGFFLTRRKVFSTLNEFVNYYTTTSDGLCVKLEKPCLKIQVPTPFDLSYKTADQWEIDRNSIQLLKRLGSGQFGEVWEGLWNNTTPVAVKTLKPGSMDPNDFLREAQIMKSLRHPKLIQLYAVCTLEDPIYIITELMRHGSLQEYLQNDGGSKIHLIQQVDMAAQVASGMAYLESQNYIHRDLAARNVLVGEHNIYKVADFGLARVFKVDNEDIYESKHEIKLPVKWTAPEAIRTNKFSIKSDVWSFGILLYEIITYGKMPYSGMTGAQVIQMLSQNYRLPQPSNCPQQFYSIMLECWNVEPKQRPTFETLHWKLEDYFETDCSYSDTNNFIN

SEQ ID NO: 198 - protein, 512 aa, Mus musculus; identical to SEQ ID NO: 197

SEQ ID NO: 199 - DNA, 1518 bp, Homo sapiens
atggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagcctttctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctag

SEQ ID NO: 200 - protein, 505 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 201 - DNA, 1500 bp, Mus musculus
atggggctgctgagcagcaagaggcaggtcagtgagaagggcaagggctggagccccgtgaagatccgcacccaggacaaggctcccccacccctgccacccctggttgtcttcaaccaccttgccccaccatctcctaaccaggacccagatgaagaggagcgttttgtggtggctctgtttgactatgccgctgtgaatgacagggaccttcaggtgctgaagggtgagaagctccaggtcttgaggagcactggagactggtggttggccaggtcactcgtcacaggaagagaaggttatgtgcccagcaactttgtggccccagtagagactctggaagtagaaaaatggttcttcaggaccatcagccggaaggatgctgagaggcagttgctggctccgatgaacaaggccggctcctttctcatcagagagagtgagagcaataaaggtgccttttccctgtccgtgaaagatatcaccacccagggggaggtggtcaagcactataagatccgatcactggacaatggaggctattacatctccccccggatcacctttcccaccctccaggccctggtgcagcactattcaaagaaaggggatggtttgtgtcagaagttgactctgccctgtgtgaacctggccccgaagaacctttgggcccaagatgaatgggaaatccccaggcagtctctcaagttggtccggaaacttgggtctgggcagtttggcgaagtctggatgggttattacaaaaataacatgaaggtggccatcaagaccctgaaggagggaaccatgtcaccggaagctttcctgggcgaggccaacgtgatgaaaaccctgcagcatgagaggctggttcgtctctacgctgtggtcaccagagagcccatttacatcgtcactgaatacatggccagaggatgcttgctggattttctgaagaccgatgaaggtagcaggttgtcccttccaaggctgattgacatgtcagcccaggttgcagaggggatggcttacatagagcgcatgaattccatccaccgtgacctgcgggcagccaacatcctggtgtctgagacgttgtgctgcaaaatcgctgacttcggcttggccaggatcattgacagtgaatacactgcccaagagggggccaagttccccatcaagtggaccgccccggaggccatccacttcggggtgtttaccatcaaggctgatgtgtggtccttcggagtcttgctgatggagattgtcacctatgggcgcgttccctacccaggaatgagcaaccctgaggtcatccgtagcctggagcacggctaccgaatgccatgcccggagacatgtccaccggagttgtacaatgatatcatcactgagtgctggcggggccggccagaggagcggcctacctttgagttcctgcagtcggtgttggaggacttctacacagccacggagggccaatatgagctgcagccctag

SEQ ID NO: 202 - protein, 499 aa, Mus musculus
MGLLSSKRQVSEKGKGWSPVKIRTQDKAPPPLPPLVVFNHLAPPSPNQDPDEEERFVVALFDYAAVNDRDLQVLKGEKLQVLRSTGDWWLARSLVTGREGYVPSNFVAPVETLEVEKWFFRTISRKDAERQLLAPMNKAGSFLIRESESNKGAFSLSVKDITTQGEVVKHYKIRSLDNGGYYISPRITFPTLQALVQHYSKKGDGLCQKLTLPCVNLAPKNLWAQDEWEIPRQSLKLVRKLGSGQFGEVWMGYYKNNMKVAIKTLKEGTMSPEAFLGEANVMKTLQHERLVRLYAVVTREPIYIVTEYMARGCLLDFLKTDEGSRLSLPRLIDMSAQVAEGMAYIERMNSIHRDLRAANILVSETLCCKIADFGLARIIDSEYTAQEGAKFPIKWTAPEAIHFGVFTIKADVWSFGVLLMEIVTYGRVPYPGMSNPEVIRSLEHGYRMPCPETCPPELYNDIITECWRGRPEERPTFEFLQSVLEDFYTATEGQYELQP

SEQ ID NO: 203 - DNA, 1614 bp, Homo sapiens
atgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaa

SEQ ID NO: 204 - DNA, 1605 bp, Homo sapiens
atgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaa

SEQ ID NO: 205 - DNA, 1449 bp, Homo sapiens
atgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaa

SEQ ID NO: 206 - protein, 537 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 207 - protein, 534 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 208 - protein, 482 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 209 - DNA, 1614 bp, Mus musculus
atgggctgtgtgcaatgtaaggataaagaagcagcgaaactgacagaggagagggacggcagcctgaaccagagctctgggtaccgctatggcacagaccccacccctcagcactaccccagcttcggcgtgacctccatcccgaactacaacaacttccacgcagctgggggccagggactcaccgtctttgggggtgtgaactcctcctctcacactgggaccctacgcacgagaggagggacaggagtgacactgtttgtggcgctttatgactatgaagcacggacggaagatgacctgagttttcacaaaggagaaaaatttcaaatattgaacagctcggaaggagactggtgggaagcccgctccttgacaaccggggaaactggttacattcccagcaattacgtggctccagttgactccatccaggcagaagagtggtactttggaaaacttggccgcaaagatgctgagagacagctcctgtcctttggaaacccaagaggtacctttcttatccgcgagagcgaaaccaccaaaggtgcctactcactttccatccgtgattgggatgatatgaaaggggaccacgtcaaacattataaaatccgcaagcttgacaatggtggatactatatcacaacgcgggcccagtttgaaacacttcagcaactggtacagcattactcagagagagccgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaatacaaaagtagccataaagacccttaagccaggcaccatgtctccggagtccttcctggaggaggcgcagatcatgaagaagctgaagcatgacaagctggtgcagctctacgcggtcgtgtctgaggagcccatttacatcgtcacggagtacatgagcaaaggaagtttgcttgacttcttaaaagatggtgaaggaagagctctgaagttgccaaaccttgtggacatggcggcacaggttgctgcaggaatggcttacatcgagcgcatgaattatatccacagagatctgcgatcagcaaacattctagtggggaatggactaatttgcaagattgctgactttggattggctcggttgattgaagacaatgaatacacagcaagacaaggtgcgaagtttcccattaagtggacagcccccgaagcggccctgtatggaaggttcacaatcaagtctgacgtatggtcttttggaatcttactcacagagctggtcaccaaaggaagagtgccatacccaggcatgaacaaccgggaggtgctggagcaggtggagagaggctataggatgccctgcccacaggactgcccgatctccctgcacgagctcatgatccactgctggaaaaaggatccggaagagcgcccgaccttcgagtacttgcagggcttcctggaggactactttacggccacagagccccagtatcagcccggtgaaaacctgtga

SEQ ID NO: 210 - DNA, 1605 bp, Mus musculus
atgggctgtgtgcaatgtaaggataaagaagcagcgaaactgacagaggagagggacggcagcctgaaccagagctctgggtaccgctatggcacagaccccacccctcagcactaccccagcttcggcgtgacctccatcccgaactacaacaacttccacgcagctgggggccagggactcaccgtctttgggggtgtgaactcctcctctcacactgggaccctacgcacgagaggagggacaggagtgacactgtttgtggcgctttatgactatgaagcacggacggaagatgacctgagttttcacaaaggagaaaaatttcaaatattgaacagctcggaaggagactggtgggaagcccgctccttgacaaccggggaaactggttacattcccagcaattacgtggctccagttgactccatccaggcagaagagtggtactttggaaaacttggccgcaaagatgctgagagacagctcctgtcctttggaaacccaagaggtacctttcttatccgcgagagcgaaaccaccaaaggtgcctactcactttccatccgtgattgggatgatatgaaaggggaccacgtcaaacattataaaatccgcaagcttgacaatggtggatactatatcacaacgcgggcccagtttgaaacacttcagcaactggtacagcattactcagagaaagctgatggtttgtgttttaacttaactgtggtttcatcaagttgtaccccacaaacttctggattggctaaagatgcttgggaagttgcacgtgactcgttgtttctggagaagaagctggggcaggggtgtttcgctgaagtgtggcttggtacctggaatggaaatacaaaagtagccataaagacccttaagccaggcaccatgtctccggagtccttcctggaggaggcgcagatcatgaagaagctgaagcatgacaagctggtgcagctctacgcggtcgtgtctgaggagcccatttacatcgtcacggagtacatgagcaaaggaagtttgcttgacttcttaaaagatggtgaaggaagagctctgaagttgccaaaccttgtggacatggcggcacaggttgctgcaggaatggcttacatcgagcgcatgaattatatccacagagatctgcgatcagcaaacattctagtggggaatggactaatttgcaagattgctgactttggattggctcggttgattgaagacaatgaatacacagcaagacaaggtgcgaagtttcccattaagtggacagcccccgaagcggccctgtatggaaggttcacaatcaagtctgacgtatggtcttttggaatcttactcacagagctggtcaccaaaggaagagtgccatacccaggcatgaacaaccgggaggtgctggagcaggtggagagaggctataggatgccctgcccacaggactgcccgatctccctgcacgagctcatgatccactgctggaaaaaggatccggaagagcgcccgaccttcgagtacttgcagggcttcctggaggactactttacggccacagagccccagtatcagcccggtgaaaacctgtga

SEQ ID NO: 211 - DNA, 1605 bp, Mus musculus; identical to SEQ ID NO: 210

SEQ ID NO: 212 - protein, 537 aa, Mus musculus
MGCVQCKDKEAAKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMSKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQGFLEDYFTATEPQYQPGENL

SEQ ID NO: 213 - protein, 534 aa, Mus musculus
MGCVQCKDKEAAKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVVSSSCTPQTSGLAKDAWEVARDSLFLEKKLGQGCFAEVWLGTWNGNTKVAIKTLKPGTMSPESFLEEAQIMKKLKHDKLVQLYAVVSEEPIYIVTEYMSKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQGFLEDYFTATEPQYQPGENL

SEQ ID NO: 214 - protein, 534 aa, Mus musculus; identical to SEQ ID NO: 213

SEQ ID NO: 215 - DNA, 1530 bp, Homo sapiens
atgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttga

SEQ ID NO: 216 - DNA, 1530 bp, Homo sapiens; identical to SEQ ID NO: 215

SEQ ID NO: 217 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 218 - protein, 509 aa, Homo sapiens; identical to SEQ ID NO: 217

SEQ ID NO: 219 - DNA, 1563 bp, Mus musculus
atgggggcctctgagctgacgatctcggggatcatgggctgtgtctgcagctcaaaccctgaagatgactggatggagaacattgacgtgtgtgaaaactgccactatcccatagtcccactggacagcaagatctcgctgcccatccggaatggctctgaagtgcgggacccactggtcacctatgagggatctctcccaccagcatccccgctgcaagacaacctggttatcgccctgcacagttatgagccctcccatgatggagacttgggctttgagaagggtgaacagctccgaatcctggagcagagcggtgagtggtggaaggctcagtccctgacgactggccaagaaggcttcattcccttcaacttcgtggcgaaagcaaacagcctggagcctgaaccttggttcttcaagaatctgagccgtaaggacgccgagcggcagcttttggcgcccgggaacacgcatggatccttcctgatccgggaaagcgaaagcactgcggggtccttttccctgtcggtcagagacttcgaccagaaccagggagaagtggtgaaacattacaagatccgtaacctagacaacggtggcttctacatctcccctcgtatcacttttcccggattgcacgatctagtccgccattacaccaacgcctctgatgggctgtgcacaaagttgagccgtccttgccagacccagaagccccagaaaccatggtgggaggacgaatgggaagttcccagggaaacactgaagttggtggagcggctgggagctggccagttcggggaagtgtggatggggtactacaacggacacacgaaggtggcggtgaagagtctgaaacaagggagcatgtcccccgacgccttcctggctgaggctaacctcatgaagcagctgcagcacccgcggctagtccggctttatgcagtggtcacccaggaacccatctacatcatcacggaatacatggagaacgggagcctagtagattttctcaagactccctcgggcatcaagttgaatgtcaacaaacttttggacatggcagcccagattgcagagggcatggcgttcatcgaagaacagaattacatccatcgggacctgcgcgccgccaacatcctggtgtctgacacgctgagctgcaagattgcagactttggcctggcgcgcctcattgaggacaatgagtacacggcccgggagggggccaaatttcccattaagtggacagcaccagaagccattaactatgggaccttcaccatcaagtcagacgtgtggtccttcgggatcttgcttacagagatcgtcacccacggtcgaatcccttacccaggaatgaccaaccctgaagtcattcagaacctggagagaggctaccgcatggtgagacctgacaactgtccggaagagctgtaccacctcatgatgctgtgctggaaggagcgcccagaggaccggcccacgtttgactaccttcggagtgttctggatgacttcttcacagccacagagggccagtaccagccccagccttga

SEQ ID NO: 220 - DNA, 1530 bp, Mus musculus
atgggctgtgtctgcagctcaaaccctgaagatgactggatggagaacattgacgtgtgtgaaaactgccactatcccatagtcccactggacagcaagatctcgctgcccatccggaatggctctgaagtgcgggacccactggtcacctatgagggatctctcccaccagcatccccgctgcaagacaacctggttatcgccctgcacagttatgagccctcccatgatggagacttgggctttgagaagggtgaacagctccgaatcctggagcagagcggtgagtggtggaaggctcagtccctgacgactggccaagaaggcttcattcccttcaacttcgtggcgaaagcaaacagcctggagcctgaaccttggttcttcaagaatctgagccgtaaggacgccgagcggcagcttttggcgcccgggaacacgcatggatccttcctgatccgggaaagcgaaagcactgcggggtccttttccctgtcggtcagagacttcgaccagaaccagggagaagtggtgaaacattacaagatccgtaacctagacaacggtggcttctacatctcccctcgtatcacttttcccggattgcacgatctagtccgccattacaccaacgcctctgatgggctgtgcacaaagttgagccgtccttgccagacccagaagccccagaaaccatggtgggaggacgaatgggaagttcccagggaaacactgaagttggtggagcggctgggagctggccagttcggggaagtgtggatggggtactacaacggacacacgaaggtggcggtgaagagtctgaaacaagggagcatgtcccccgacgccttcctggctgaggctaacctcatgaagcagctgcagcacccgcggctagtccggctttatgcagtggtcacccaggaacccatctacatcatcacggaatacatggagaacgggagcctagtagattttctcaagactccctcgggcatcaagttgaatgtcaacaaacttttggacatggcagcccagattgcagagggcatggcgttcatcgaagaacagaattacatccatcgggacctgcgcgccgccaacatcctggtgtctgacacgctgagctgcaagattgcagactttggcctggcgcgcctcattgaggacaatgagtacacggcccgggagggggccaaatttcccattaagtggacagcaccagaagccattaactatgggaccttcaccatcaagtcagacgtgtggtccttcgggatcttgcttacagagatcgtcacccacggtcgaatcccttacccaggaatgaccaaccctgaagtcattcagaacctggagagaggctaccgcatggtgagacctgacaactgtccggaagagctgtaccacctcatgatgctgtgctggaaggagcgcccagaggaccggcccacgtttgactaccttcggagtgttctggatgacttcttcacagccacagagggccagtaccagccccagccttga

SEQ ID NO: 221 - DNA, 1530 bp, Mus musculus; identical to SEQ ID NO: 220

SEQ ID NO: 222 - protein, 520 aa, Mus musculus
MGASELTISGIMGCVCSSNPEDDWMENIDVCENCHYPIVPLDSKISLPIRNGSEVRDPLVTYEGSLPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHDLVRHYTNASDGLCTKLSRPCQTQKPQKPWWEDEWEVPRETLKLVERLGAGQFGEVWMGYYNGHTKVAVKSLKQGSMSPDAFLAEANLMKQLQHPRLVRLYAVVTQEPIYIITEYMENGSLVDFLKTPSGIKLNVNKLLDMAAQIAEGMAFIEEQNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYHLMMLCWKERPEDRPTFDYLRSVLDDFFTATEGQYQPQP

SEQ ID NO: 223 - protein, 509 aa, Mus musculus
MGCVCSSNPEDDWMENIDVCENCHYPIVPLDSKISLPIRNGSEVRDPLVTYEGSLPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHDLVRHYTNASDGLCTKLSRPCQTQKPQKPWWEDEWEVPRETLKLVERLGAGQFGEVWMGYYNGHTKVAVKSLKQGSMSPDAFLAEANLMKQLQHPRLVRLYAVVTQEPIYIITEYMENGSLVDFLKTPSGIKLNVNKLLDMAAQIAEGMAFIEEQNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYHLMMLCWKERPEDRPTFDYLRSVLDDFFTATEGQYQPQP

SEQ ID NO: 224 - protein, 509 aa, Mus musculus; identical to SEQ ID NO: 223

SEQ ID NO: 225 - DNA, 1632 bp, Homo sapiens
atgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataa

SEQ ID NO: 226 - protein, 543 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 227 - DNA, 1626 bp, Mus musculus
atgggctgcattaaaagtaaagaaaacaaaagtccagccataaaatacacaccggaaaatcttacagagcctgtaagcccaagtgccagtcattatggagtggaacatgctacagttgccccgacctcttccacaaagggagcatcagttaattttaacagtctttccatgacaccctttggagggtcctcaggggtgactccttttggaggagcgtcttcctcattctcagtggtgtcaagttcatatcctacaggtttaacaggtggtgtcactatatttgtggccttgtatgattatgaagctagaactacagaagacctttcctttaagaagggtgaacgatttcaaataattaacaatacggaaggagactggtgggaagcaagatcaattgctaccggaaagagtggttatatccctagcaattacgtagtgcctgcagattccattcaggcagaagaatggtattttggcaaaatggggagaaaagatgcggaaagattacttctgaatcctgggaatcagcgaggtattttcttagtaagagaaagtgaaactactaaaggtgcttactccctctcaatccgtgattgggatgaggtgaggggtgacaatgtgaagcattacaagatcagaaaacttgacaatggtggctactacatcacgaccagagctcagtttgatacactgcagaagctggtgaagcactacacagaacatgctgatggattatgccacaagttaacaactgtgtgtcctactgtgaaaccccagactcaaggtctggcaaaagatgcttgggaaatccctcgagaatcattgcgactagaggtgaaactaggtcaaggatgctttggggaagtgtggatgggaacatggaatggaactacaaaagtagcaatcaaaacactaaagccaggtacaatgatgccagaagcattccttcaagaagctcagataatgaaaaagctaagacacgataaacttgttccactctatgcagttgtttctgaagagcccatttatattgtcaccgagtttatgtcaaaaggaagcttgttagatttccttaaagaaggagatggaaagtatttgaagcttccacagctggttgatatggctgctcagatcgctgatggcatggcgtatattgaaagaatgaactatattcaccgagatctccgagctgctaatattcttgtaggagaaaatcttatatgcaaaatagcagattttggcttagcaagattaattgaagacaatgaatacacggcaagacaaggtgcaaaatttccaatcaagtggacagctcctgaggctgctctgtatggtcgatttacaataaagtcagatgtgtggtcatttggaattctacagacagagctggtaacaaaaggaagagtgccatatccaggtatggtaaaccgtgaagtattggaacaagtagagcggggatacagaatgccttgcccccagggctgtcccgaatccctccatgaattgatgaatctttgctggaagaaggatcctgatgaaagaccaacatttgaatatattcagtccttcttggaagactacttcactgctacagagccacagtaccaaccaggagaaaatttataa

SEQ ID NO: 228 - DNA, 1626 bp, Mus musculus; identical to SEQ ID NO: 227

SEQ ID NO: 229 - DNA, 1626 bp, Mus musculus; identical to SEQ ID NO: 227

SEQ ID NO: 230 - protein, 541 aa, Mus musculus
MGCIKSKENKSPAIKYTPENLTEPVSPSASHYGVEHATVAPTSSTKGASVNFNSLSMTPFGGSSGVTPFGGASSSFSVVSSSYPTGLTGGVTIFVALYDYEARTTEDLSFKKGERFQIINNTEGDWWEARSIATGKSGYIPSNYVVPADSIQAEEWYFGKMGRKDAERLLLNPGNQRGIFLVRESETTKGAYSLSIRDWDEVRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLICKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 231 - protein, 541 aa, Mus musculus; identical to SEQ ID NO: 230

SEQ ID NO: 232 - protein, 541 aa, Mus musculus; identical to SEQ ID NO: 230

SEQ ID NO: 233 - DNA, 1539 bp, Homo sapiens
atgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttag

SEQ ID NO: 234 - DNA, 1476 bp, Homo sapiens
atgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttag

SEQ ID NO: 235 - protein, 512 aa, Homo sapiens
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 236 - protein, 491 aa, Homo sapiens
MGCIKSKGKDSLSDDGVDLKTQPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 237 - DNA, 1539 bp, Mus musculus
atgggatgtattaaatcaaaaaggaaagacaatctcaatgacgatgaagtagattcgaagactcaaccagtacgtaatactgaccgaactatttatgtgagagatccaacgtccaataaacagcaaaggccagttcctgaatttcatcttttaccaggacagagatttcaaacaaaagatccagaggaacaaggtgacattgtggtggccttatacccttatgatggcatccacccagatgacttgtccttcaagaaaggagaaaagatgaaagttctagaagagcatggggaatggtggaaagctaagtccctttcatcaaagagagaaggcttcatccccagcaactacgtggccaaggtcaacaccttagaaactgaagagtggttcttcaaggacataacaaggaaagatgcagagcgacagcttctggcaccagggaacagtgcaggagctttccttatcagagaaagcgaaactttaaagggaagcttctctctttctgtcagagattatgaccctatgcatggtgatgtcattaagcactacaaaattagaagtctggacaatggtggctattacatctctcctcgcatcacttttccctgcatcagtgacatgattaagcattaccaaaagcagtctgatggtctatgcagaagactggagaaggcatgcatcagtcccaaacctcagaagccatgggataaagatgcctgggagatcccccgggagtccattaagttggtgaaaaagcttggcgcagggcagtttggggaagtctggatgggttactataacaacagcacaaaggtggctgtgaagaccctcaagcccggcaccatgtctgtgcaggcattcctggaagaggccaacctcatgaagaccttgcaacatgacaagctagtgcggctgtacgctgtggtcaccaaggaggagcccatctacatcatcaccgagttcatggctaagggtagtttgctggatttcctcaagagtgatgaaggtggcaaggtgctgctgcccaagctcattgacttctcggcccagattgcagaaggcatggcgtacatcgagcggaagaactacatccaccgtgatctgcgagctgctaacgtcctggtctctgagtcactcatgtgcaagattgcagactttggcctcgcgagagtcatcgaagataacgagtacacagcaagggaaggtgcgaagttccctatcaagtggacagctccagaggccatcaacttcggctgcttcactatcaaatctgacgtgtggtccttcggaattctcctgtatgagattgtcacctatgggaagattccctacccagggagaaccaacgcagatgtgatgagcgcactgtcacagggatatcgaatgccacgcatggagaactgcccagatgagctctatgacatcatgaaaatgtgttggaaagaaaaggcagaggagaggccaacttttgactacttacagagtgtcctggatgacttctatacagccacagaagggcagtatcagcagcaaccgtag

SEQ ID NO: 238 - DNA, 1476 bp, Mus musculus
atgggatgtattaaatcaaaaaggaaagacaatctcaatgacgatgaagtagattcgaagactcaaccagttcctgaatttcatcttttaccaggacagagatttcaaacaaaagatccagaggaacaaggtgacattgtggtggccttatacccttatgatggcatccacccagatgacttgtccttcaagaaaggagaaaagatgaaagttctagaagagcatggggaatggtggaaagctaagtccctttcatcaaagagagaaggcttcatccccagcaactacgtggccaaggtcaacaccttagaaactgaagagtggttcttcaaggacataacaaggaaagatgcagagcgacagcttctggcaccagggaacagtgcaggagctttccttatcagagaaagcgaaactttaaagggaagcttctctctttctgtcagagattatgaccctatgcatggtgatgtcattaagcactacaaaattagaagtctggacaatggtggctattacatctctcctcgcatcacttttccctgcatcagtgacatgattaagcattaccaaaagcagtctgatggtctatgcagaagactggagaaggcatgcatcagtcccaaacctcagaagccatgggataaagatgcctgggagatcccccgggagtccattaagttggtgaaaaagcttggcgcagggcagtttggggaagtctggatgggttactataacaacagcacaaaggtggctgtgaagaccctcaagcccggcaccatgtctgtgcaggcattcctggaagaggccaacctcatgaagaccttgcaacatgacaagctagtgcggctgtacgctgtggtcaccaaggaggagcccatctacatcatcaccgagttcatggctaagggtagtttgctggatttcctcaagagtgatgaaggtggcaaggtgctgctgcccaagctcattgacttctcggcccagattgcagaaggcatggcgtacatcgagcggaagaactacatccaccgtgatctgcgagctgctaacgtcctggtctctgagtcactcatgtgcaagattgcagactttggcctcgcgagagtcatcgaagataacgagtacacagcaagggaaggtgcgaagttccctatcaagtggacagctccagaggccatcaacttcggctgcttcactatcaaatctgacgtgtggtccttcggaattctcctgtatgagattgtcacctatgggaagattccctacccagggagaaccaacgcagatgtgatgagcgcactgtcacagggatatcgaatgccacgcatggagaactgcccagatgagctctatgacatcatgaaaatgtgttggaaagaaaaggcagaggagaggccaacttttgactacttacagagtgtcctggatgacttctatacagccacagaagggcagtatcagcagcaaccgtag

SEQ ID NO: 239 - protein, 512 aa, Mus musculus
MGCIKSKRKDNLNDDEVDSKTQPVRNTDRTIYVRDPTSNKQQRPVPEFHLLPGQRFQTKDPEEQGDIVVALYPYDGIHPDDLSFKKGEKMKVLEEHGEWWKAKSLSSKREGFIPSNYVAKVNTLETEEWFFKDITRKDAERQLLAPGNSAGAFLIRESETLKGSFSLSVRDYDPMHGDVIKHYKIRSLDNGGYYISPRITFPCISDMIKHYQKQSDGLCRRLEKACISPKPQKPWDKDAWEIPRESIKLVKKLGAGQFGEVWMGYYNNSTKVAVKTLKPGTMSVQAFLEEANLMKTLQHDKLVRLYAVVTKEEPIYIITEFMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMSALSQGYRMPRMENCPDELYDIMKMCWKEKAEERPTFDYLQSVLDDFYTATEGQYQQQP

SEQ ID NO: 240 - protein, 491 aa, Mus musculus
MGCIKSKRKDNLNDDEVDSKTQPVPEFHLLPGQRFQTKDPEEQGDIVVALYPYDGIHPDDLSFKKGEKMKVLEEHGEWWKAKSLSSKREGFIPSNYVAKVNTLETEEWFFKDITRKDAERQLLAPGNSAGAFLIRESETLKGSFSLSVRDYDPMHGDVIKHYKIRSLDNGGYYISPRITFPCISDMIKHYQKQSDGLCRRLEKACISPKPQKPWDKDAWEIPRESIKLVKKLGAGQFGEVWMGYYNNSTKVAVKTLKPGTMSVQAFLEEANLMKTLQHDKLVRLYAVVTKEEPIYIITEFMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMSALSQGYRMPRMENCPDELYDIMKMCWKEKAEERPTFDYLQSVLDDFYTATEGQYQQQP

SEQ ID NO: 241 - DNA, 1590 bp, Homo sapiens
atgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatag

SEQ ID NO: 242 - DNA, 1590 bp, Homo sapiens; identical to SEQ ID NO: 241

SEQ ID NO: 243 - DNA, 1590 bp, Homo sapiens; identical to SEQ ID NO: 241

SEQ ID NO: 244 - protein, 529 aa, Homo sapiens
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAALFGRFTIKSDVWSFGILLTELITKGRIPYPGMNKREVLEQVEQGYHMPCPPGCPASLYEAMEQTWRLDPEERPTFEYLQSFLEDYFTSAEPQYQPGDQT

SEQ ID NO: 245 - protein, 529 aa, Homo sapiens; identical to SEQ ID NO: 244

SEQ ID NO: 246 - protein, 529 aa, Homo sapiens; identical to SEQ ID NO: 244

SEQ ID NO: 247 - DNA, 1554 bp, Mus musculus
atgggctgtgtgttctgcaagaagttggagcctgcatccaaggaggatgtgggcctggaaggggacttccggagccaaacggctgaagaacgctatttccctgaccccactcaaggccggacttcgtccgtctttcctcagcccaccagccctgctttcctcaacactggcaacatgagaagcatctcagggaccggagtgaccatattcgtcgccctgtacgactatgaggccaggacaggggatgacctcaccttcaccaaaggcgagaagttccacatcctgaacaatacggagtatgactggtgggaggctcgctccctgagctccggacacagaggctatgttcccagcaactatgttgctcctgtggattccatccaggctgaagagtggtacttcggaaagatcagtagaaaggatgcagagaggcagcttctgtcctctggtaacccccagggggcctttctcattcgggaaagcgagaccaccaaaggggcctactccctgtccatccgtgactgggaccagaacagaggcgatcacataaagcattataagatccgaaagctggacacgggcggctactacatcaccacacgggcccagtttgactccatacaggacctagtgcggcactacatggaagtgaatgatggtctgtgctacttgcttacggcgccttgtaccaccactaagccccagactctaggcctggccaaggatgcctgggagatcgaccggaactccatagcactggaacgcaggctgggcaccggctgctttggagatgtgtggctgggcacatggaactgcagcacaaaggtggcagtgaagacgctgaagccgggcaccatgtccccgaaggcattcctggaggaggcacagatcatgaagctgctgaggcacgacaagctggtgcagctgtatgcggtggtgtcggaggaacccatttatattgtgacagagttcatgtgctatggtagcttgctggatttcctaaaggatcgagaaggtcagaacttgatgctgccccatctagtggacatggctgcccaggtagccgagggcatggcctacatggaacgcatgaactatatccaccgagacttgagggcagccaacatcctggtgggggaatacctaatatgcaagatcgctgacttcgggctggcacgcctcatagaggacaatgagtataacccccaacaaggaaccaagttccccatcaagtggacagccccagaggccgccctctttggcagattcactgtcaaatcagacgtgtggtcctttgggattctgctcactgaactgatcaccaagggcagagttccctacccaggtatgaacaaccgggaagtgttggaacaggtggagcatggctaccacatgccgtgccctccaggatgtcctgcatccctgtatgaggtcatggagcaggcgtggcgcctggatccagaggagaggcccacctttgagtacctgcagtctttcctggaagactatttcacctccacagaaccacagtaccagcctggagaccagacatag

SEQ ID NO: 248 - protein, 517 aa, Mus musculus
MGCVFCKKLEPASKEDVGLEGDFRSQTAEERYFPDPTQGRTSSVFPQPTSPAFLNTGNMRSISGTGVTIFVALYDYEARTGDDLTFTKGEKFHILNNTEYDWWEARSLSSGHRGYVPSNYVAPVDSIQAEEWYFGKISRKDAERQLLSSGNPQGAFLIRESETTKGAYSLSIRDWDQNRGDHIKHYKIRKLDTGGYYITTRAQFDSIQDLVRHYMEVNDGLCYLLTAPCTTTKPQTLGLAKDAWEIDRNSIALERRLGTGCFGDVWLGTWNCSTKVAVKTLKPGTMSPKAFLEEAQIMKLLRHDKLVQLYAVVSEEPIYIVTEFMCYGSLLDFLKDREGQNLMLPHLVDMAAQVAEGMAYMERMNYIHRDLRAANILVGEYLICKIADFGLARLIEDNEYNPQQGTKFPIKWTAPEAALFGRFTVKSDVWSFGILLTELITKGRVPYPGMNNREVLEQVEHGYHMPCPPGCPASLYEVMEQAWRLDPEERPTFEYLQSFLEDYFTSTEPQYQPGDQT

SEQ ID NO: 249 - DNA, 1518 bp, Homo sapiens
atggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 250 - DNA, 1518 bp, Homo sapiens; identical to SEQ ID NO: 249

SEQ ID NO: 251 - DNA, 1515 bp, Homo sapiens
atggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggagggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 252 - DNA, 1515 bp, Homo sapiens; identical to SEQ ID NO: 251

SEQ ID NO: 253 - DNA, 1521 bp, Homo sapiens
atgatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 254 - DNA, 1518 bp, Homo sapiens; identical to SEQ ID NO: 249

SEQ ID NO: 255 - protein, 526 aa, Homo sapiens
MGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 256 - protein, 505 aa, Homo sapiens
MGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 257 - protein, 505 aa, Homo sapiens; identical to SEQ ID NO: 256

SEQ ID NO: 258 - protein, 466 aa, Homo sapiens
MGGRSSCEDPGCPRDEERAPRMGCMKSKFLQVGGNTFSKTETSASPHCPVYVPDPTSTIKPGPNSHNSNTPGIREGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVI

SEQ ID NO: 259 - protein, 504 aa, Homo sapiens
MGCMKSKFLQVGGNTFSKTETSASPHCPVYVPDPTSTIKPGPNSHNSNTPGIREGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 260 - protein, 506 aa, Homo sapiens
MMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 261 - DNA, 1507 bp, Mus musculus
atgcgtgaagtccaggttcctccgagatggaagcaaggcctcaaaaacagagccaagtgccaatcagaagggccctgtgtatgtgccggatcccacgtcctccagcaagctgggaccaaacaacagcaacagcatgcccccagggtttgtggagggctctgaggataccattgtggtcgcactgtacgactatgaggctattcaccgtgaagacctcagcttccagaagggagaccagatggtggttctggaggaggctggggagtggtggaaggcacggtccctggctaccaagaaggaaggctacatcccaagcaactatgtggctcgagttaactctttggagacagaagagtggttcttcaaggggatcagccggaaggatgcagagcgccacctcctggctccaggcaacatgctgggctccttcatgatccgggacagtgagaccaccaaagggagctactcgttgtctgttcgagactttgacccccagcacggagacaccgtgaagcactataagatccggacgctggacagtggaggcttctacatctctccaaggagcaccttcagcagcctgcaggaactcgtgctccactacaagaaggggaaggatgggctctgccagaagctgtcagtgccctgtgtgtctcccaaaccccagaagccatgggagaaagatgcttgggagattcctcgagaatccctccagatggagaagaaacttggagctgggcagtttggagaagtgtggatggccacctacaacaagcacaccaaagtggcggtgaagacaatgaagccagggagcatgtccgtggaggccttcctggctgaggccaacctgatgaagtcgctgcagcatgacaaactggtgaagctacacgctgtggtctctcaggagcccatctttattgtcacggagttcatggccaaaggaagcctgctggactttctcaagagtgaagaaggcagcaagcagccactgccaaaactcattgacttctcagcccagatctcagaaggcatggccttcattgagcagaggaactacatccaccgagacctgagggctgccaacatcttagtctctgcatcactggtgtgtaagattgctgactttggactggcacgaatcatcgaggacaatgagtacacagctcgggaaggagccaagttccccatcaagtggacagctcctgaagccatcaactttggttccttcaccatcaagtcagatgtctggtcctttggtatcctgctgatggaaattgtcacctatggccggatcccttacccaggtatgtcaaacccagaggtgattcgggcactagagcatgggtaccgtatgcctcgaccagataactgtccagaagagctctacaatatcatgatccgctgctggaagaaccgccccgaggaacggcccacctttgaatacatccagagtgtgctggatgacttctacacggccactgagagccagtatcagcagcagccttga

SEQ ID NO: 262 - DNA, 1512 bp, Mus musculus
atgggatgcgtgaagtccaggttcctccgagatggaagcaaggcctcaaaaacagagccaagtgccaatcagaagggccctgtgtatgtgccggatcccacgtcctccagcaagctgggaccaaacaacagcaacagcatgcccccagggtttgtggagggctctgaggataccattgtggtcgcactgtacgactatgaggctattcaccgtgaagacctcagcttccagaagggagaccagatggtggttctggaggaggctggggagtggtggaaggcacggtccctggctaccaagaaggaaggctacatcccaagcaactatgtggctcgagttaactctttggagacagaagagtggttcttcaaggggatcagccggaaggatgcagagcgccacctcctggctccaggcaacatgctgggctccttcatgatccgggacagtgagaccaccaaagggagctactcgttgtctgttcgagactttgacccccagcacggagacaccgtgaagcactataagatccggacgctggacagtggaggcttctacatctctccaaggagcaccttcagcagcctgcaggaactcgtgctccactacaagaaggggaaggatgggctctgccagaagctgtcagtgccctgtgtgtctcccaaaccccagaagccatgggagaaagatgcttgggagattcctcgagaatccctccagatggagaagaaacttggagctgggcagtttggagaagtgtggatggccacctacaacaagcacaccaaagtggcggtgaagacaatgaagccagggagcatgtccgtggaggccttcctggctgaggccaacctgatgaagtcgctgcagcatgacaaactggtgaagctacacgctgtggtctctcaggagcccatctttattgtcacggagttcatggccaaaggaagcctgctggactttctcaagagtgaagaaggcagcaagcagccactgccaaaactcattgacttctcagcccagatctcagaaggcatggccttcattgagcagaggaactacatccaccgagacctgagggctgccaacatcttagtctctgcatcactggtgtgtaagattgctgactttggactggcacgaatcatcgaggacaatgagtacacagctcgggaaggagccaagttccccatcaagtggacagctcctgaagccatcaactttggttccttcaccatcaagtcagatgtctggtcctttggtatcctgctgatggaaattgtcacctatggccggatcccttacccaggtatgtcaaacccagaggtgattcgggcactagagcatgggtaccgtatgcctcgaccagataactgtccagaagagctctacaatatcatgatccgctgctggaagaaccgccccgaggaacggcccacctttgaatacatccagagtgtgctggatgacttctacacggccactgagagccagtatcagcagcagccttga

SEQ ID NO: 263 - protein, 524 aa, Mus musculus
MGGRSSCEDPGCPRSEGRAPRMGCVKSRFLRDGSKASKTEPSANQKGPVYVPDPTSSSKLGPNNSNSMPPGFVEGSEDTIVVALYDYEAIHREDLSFQKGDQMVVLEEAGEWWKARSLATKKEGYIPSNYVARVNSLETEEWFFKGISRKDAERHLLAPGNMLGSFMIRDSETTKGSYSLSVRDFDPQHGDTVKHYKIRTLDSGGFYISPRSTFSSLQELVLHYKKGKDGLCQKLSVPCVSPKPQKPWEKDAWEIPRESLQMEKKLGAGQFGEVWMATYNKHTKVAVKTMKPGSMSVEAFLAEANLMKSLQHDKLVKLHAVVSQEPIFIVTEFMAKGSLLDFLKSEEGSKQPLPKLIDFSAQISEGMAFIEQRNYIHRDLRAANILVSASLVCKIADFGLARIIEDNEYTAREGAKFPIKWTAPEAINFGSFTIKSDVWSFGILLMEIVTYGRIPYPGMSNPEVIRALEHGYRMPRPDNCPEELYNIMIRCWKNRPEERPTFEYIQSVLDDFYTATESQYQQQP

SEQ ID NO: 264 - protein, 503 aa, Mus musculus
MGCVKSRFLRDGSKASKTEPSANQKGPVYVPDPTSSSKLGPNNSNSMPPGFVEGSEDTIVVALYDYEAIHREDLSFQKGDQMVVLEEAGEWWKARSLATKKEGYIPSNYVARVNSLETEEWFFKGISRKDAERHLLAPGNMLGSFMIRDSETTKGSYSLSVRDFDPQHGDTVKHYKIRTLDSGGFYISPRSTFSSLQELVLHYKKGKDGLCQKLSVPCVSPKPQKPWEKDAWEIPRESLQMEKKLGAGQFGEVWMATYNKHTKVAVKTMKPGSMSVEAFLAEANLMKSLQHDKLVKLHAVVSQEPIFIVTEFMAKGSLLDFLKSEEGSKQPLPKLIDFSAQISEGMAFIEQRNYIHRDLRAANILVSASLVCKIADFGLARIIEDNEYTAREGAKFPIKWTAPEAINFGSFTIKSDVWSFGILLMEIVTYGRIPYPGMSNPEVIRALEHGYRMPRPDNCPEELYNIMIRCWKNRPEERPTFEYIQSVLDDFYTATESQYQQQP

SEQ ID NO: 265 - DNA, 1611 bp, Homo sapiens
atgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctag

SEQ ID NO: 266 - DNA, 1611 bp, Homo sapiens; identical to SEQ ID NO: 265

SEQ ID NO: 267 - protein, 536 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 268 - protein, 536 aa, Homo sapiens; identical to SEQ ID NO: 267

SEQ ID NO: 269 - DNA, 1626 bp, Mus musculus
atgggcagcaacaagagcaagcccaaggacgccagccagcggcgccgcagcctggagccctcggaaaacgtgcacggggcagggggcgccttcccggcctcacagacaccgagcaagcccgcctccgccgacggccaccgcgggcccagcgccgccttcgtgccgcccgcggccgagcccaagctcttcggaggcttcaactcctcggacaccgtcacctccccgcagagggcggggcctctggcaggtggggtgaccacctttgtggccctctatgactatgagtcacggacagagactgacctgtccttcaagaaaggggagcggctgcagattgtcaataacacgaggaaggtggatgtcagagagggagactggtggctggcacactcgctgagcacgggacagaccggttacatccccagcaactatgtggcgccctccgactccatccaggctgaggagtggtactttggcaagatcactagacgggaatcagagcggctgctgctcaacgccgagaacccgagagggaccttcctcgtgagggagagtgagaccacaaaaggtgcctactgcctctctgtatccgacttcgacaatgccaagggcctaaatgtgaaacactacaagatccgcaagctggacagcggcggtttctacatcacctcccgcacccagttcaacagcctgcagcagctcgtggcttactactccaaacatgctgatggcctgtgtcaccgcctcactaccgtatgtcccacatccaagcctcagacccagggattggccaaggatgcgtgggagatcccccgggagtccctgcggctggaggtcaagctgggccagggttgcttcggagaggtgtggatggggacctggaacggcaccacgagggttgccatcaaaactctgaagccaggcaccatgtccccagaggccttcctgcaggaggcccaagtcatgaagaaactgaggcacgagaaactggtgcagctgtatgctgtggtgtcggaagaacccatttacattgtgacagagtacatgaacaaggggagtctgctggactttctcaagggggaaacgggcaaatatttgcggctaccccagctggtggacatgtctgctcagatcgcttcaggcatggcctatgtggagcggatgaactatgtgcaccgggaccttcgagccgccaatatcctagtaggggagaacctggtgtgcaaagtggccgactttgggttggcccggctcatagaagacaacgaatacacagcccggcaaggtgccaaattccccatcaagtggaccgcccctgaagctgctctgtacggcaggttcaccatcaagtcggatgtgtggtcctttgggattctgctgaccgagctcaccactaagggaagagtgccctatcctgggatggtgaaccgtgaggttctggaccaggtggagcggggctaccggatgccttgtccccccgagtgccccgagtccctgcatgaccttatgtgccagtgctggcggaaggagcccgaggagcggcccaccttcgagtacctgcaggccttcctggaagactactttacgtccactgagccacagtaccagcccggggagaacctatag

SEQ ID NO: 270 - DNA, 1608 bp, Mus musculus
atgggcagcaacaagagcaagcccaaggacgccagccagcggcgccgcagcctggagccctcggaaaacgtgcacggggcagggggcgccttcccggcctcacagacaccgagcaagcccgcctccgccgacggccaccgcgggcccagcgccgccttcgtgccgcccgcggccgagcccaagctcttcggaggcttcaactcctcggacaccgtcacctccccgcagagggcggggcctctggcaggtggggtgaccacctttgtggccctctatgactatgagtcacggacagagactgacctgtccttcaagaaaggggagcggctgcagattgtcaataacacagagggagactggtggctggcacactcgctgagcacgggacagaccggttacatccccagcaactatgtggcgccctccgactccatccaggctgaggagtggtactttggcaagatcactagacgggaatcagagcggctgctgctcaacgccgagaacccgagagggaccttcctcgtgagggagagtgagaccacaaaaggtgcctactgcctctctgtatccgacttcgacaatgccaagggcctaaatgtgaaacactacaagatccgcaagctggacagcggcggtttctacatcacctcccgcacccagttcaacagcctgcagcagctcgtggcttactactccaaacatgctgatggcctgtgtcaccgcctcactaccgtatgtcccacatccaagcctcagacccagggattggccaaggatgcgtgggagatcccccgggagtccctgcggctggaggtcaagctgggccagggttgcttcggagaggtgtggatggggacctggaacggcaccacgagggttgccatcaaaactctgaagccaggcaccatgtccccagaggccttcctgcaggaggcccaagtcatgaagaaactgaggcacgagaaactggtgcagctgtatgctgtggtgtcggaagaacccatttacattgtgacagagtacatgaacaaggggagtctgctggactttctcaagggggaaacgggcaaatatttgcggctaccccagctggtggacatgtctgctcagatcgcttcaggcatggcctatgtggagcggatgaactatgtgcaccgggaccttcgagccgccaatatcctagtaggggagaacctggtgtgcaaagtggccgactttgggttggcccggctcatagaagacaacgaatacacagcccggcaaggtgccaaattccccatcaagtggaccgcccctgaagctgctctgtacggcaggttcaccatcaagtcggatgtgtggtcctttgggattctgctgaccgagctcaccactaagggaagagtgccctatcctgggatggtgaaccgtgaggttctggaccaggtggagcggggctaccggatgccttgtccccccgagtgccccgagtccctgcatgaccttatgtgccagtgctggcggaaggagcccgaggagcggcccaccttcgagtacctgcaggccttcctggaagactactttacgtccactgagccacagtaccagcccggggagaacctatag

SEQ ID NO: 271 - protein, 541 aa, Mus musculus
MGSNKSKPKDASQRRRSLEPSENVHGAGGAFPASQTPSKPASADGHRGPSAAFVPPAAEPKLFGGFNSSDTVTSPQRAGPLAGGVTTFVALYDYESRTETDLSFKKGERLQIVNNTRKVDVREGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMNKGSLLDFLKGETGKYLRLPQLVDMSAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 272 - protein, 535 aa, Mus musculus
MGSNKSKPKDASQRRRSLEPSENVHGAGGAFPASQTPSKPASADGHRGPSAAFVPPAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMNKGSLLDFLKGETGKYLRLPQLVDMSAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 273 - DNA, 24 bp, Artificial Sequence
  /note="Description of Artificial Sequence: Synthetic primer"
caccgtacaaagccaaaaacaagg

SEQ ID NO: 274 - DNA, 24 bp, Artificial Sequence
  /note="Description of Artificial Sequence: Synthetic primer"
aaacccttgtttttggctttgtac

SEQ ID NO: 275 - DNA, 24 bp, Artificial Sequence
  /note="Description of Artificial Sequence: Synthetic primer"
caccggagcggcttctgtacccgc

SEQ ID NO: 276 - DNA, 24 bp, Artificial Sequence
  /note="Description of Artificial Sequence: Synthetic primer"
aaacgcgggtacagaagccgctcc

SEQ ID NO: 277 - DNA, 25 bp, Artificial Sequence
  /note="Description of Artificial Sequence: Synthetic primer"
caccggcaactgcggcatagcaacc

SEQ ID NO: 278 - DNA, 25 bp, Artificial Sequence
  /note="Description of Artificial Sequence: Synthetic primer"
aaacggttgctatgccgcagttgcc

SEQ ID NO: 279 - DNA, 25 bp, Artificial Sequence
  /note="Description of Artificial Sequence: Synthetic primer"
caccggtgacctgcccggttctcag

SEQ ID NO: 280 - DNA, 25 bp, Artificial Sequence
  /note="Description of Artificial Sequence: Synthetic primer"
aaacctgagaaccgggcaggtcacc

SEQ ID NO: 281 - DNA, 25 bp, Artificial Sequence
  /note="Description of Artificial Sequence: Synthetic primer"
caccgcggggacacaggatccctgg

SEQ ID NO: 282 - DNA, 25 bp, Artificial Sequence
  /note="Description of Artificial Sequence: Synthetic primer"
aaacccagggatcctgtgtccccgc

SEQ ID NO: 283 - DNA, 25 bp, Artificial Sequence
  /note="Description of Artificial Sequence: Synthetic primer"
caccggttagggcatgccagaacag

SEQ ID NO: 284 - DNA, 25 bp, Artificial Sequence
  /note="Description of Artificial Sequence: Synthetic primer"
aaacctgttctggcatgccctaacc

SEQ ID NO: 285 - DNA, 25 bp, Artificial Sequence
  /note="Description of Artificial Sequence: Synthetic primer"
caccgatggtgtgctcaaaatcaga

SEQ ID NO: 286 - DNA, 25 bp, Artificial Sequence
  /note="Description of Artificial Sequence: Synthetic primer"
aaactctgattttgagcacaccatc

SEQ ID NO: 287 - DNA, 24 bp, Artificial Sequence
  /note="Description of Artificial Sequence: Synthetic primer"
caccgggacatccagcacagcctg

SEQ ID NO: 288 - DNA, 24 bp, Artificial Sequence
  /note="Description of Artificial Sequence: Synthetic primer"
aaaccaggctgtgctggatgtccc

SEQ ID NO: 289 - DNA, 25 bp, Artificial Sequence
  /note="Description of Artificial Sequence: Synthetic primer"
caccgtggtggtggccttcaaatca

SEQ ID NO: 290 - DNA, 25 bp, Artificial Sequence
  /note="Description of Artificial Sequence: Synthetic primer"
aaactgatttgaaggccaccaccac

SEQ ID NO: 291 - DNA, 25 bp, Artificial Sequence
  /note="Description of Artificial Sequence: Synthetic primer"
caccgcagggagcagcccacggtag

SEQ ID NO: 292 - DNA, 25 bp, Artificial Sequence
  /note="Description of Artificial Sequence: Synthetic primer"
aaacctaccgtgggctgctccctgc

SEQ ID NO: 293 - DNA, 25 bp, Artificial Sequence
  /note="Description of Artificial Sequence: Synthetic primer"
caccgagcgccaccagagaccagac

SEQ ID NO: 294 - DNA, 25 bp, Artificial Sequence
  /note="Description of Artificial Sequence: Synthetic primer"
aaacgtctggtctctggtggcgctc

SEQ ID NO: 295 - DNA, 25 bp, Artificial Sequence
  /note="Description of Artificial Sequence: Synthetic primer"
caccgctagaatccagtctggtctc

SEQ ID NO: 296 - DNA, 25 bp, Artificial Sequence
  /note="Description of Artificial Sequence: Synthetic primer"
aaacgagaccagactggattctagc

SEQ ID NO: 297 - DNA, 25 bp, Artificial Sequence
  /note="Description of Artificial Sequence: Synthetic primer"
caccgagtaatcacccagagtgcaa

SEQ ID NO: 298 - DNA, 25 bp, Artificial Sequence
  /note="Description of Artificial Sequence: Synthetic primer"
aaacttgcactctgggtgattactc

SEQ ID NO: 299 - DNA, 25 bp, Artificial Sequence
  /note="Description of Artificial Sequence: Synthetic primer"
caccgagaggacttggagtcgctga

SEQ ID NO: 300 - DNA, 25 bp, Artificial Sequence
  /note="Description of Artificial Sequence: Synthetic primer"
aaactcagcgactccaagtcctctc

SEQ ID NO: 301 - DNA, 28 bp, Artificial Sequence
  /note="Description of Artificial Sequence: Synthetic primer"
ccttgaaggaagatgatcaaatgagagc

SEQ ID NO: 302 - DNA, 23 bp, Artificial Sequence
  /note="Description of Artificial Sequence: Synthetic primer"
ccagcctggggccagttcttatc

SEQ ID NO: 303 - DNA, 34 bp, Artificial Sequence
  /note="Description of Artificial Sequence: Synthetic primer"
agtcagctagcatgtcagcaatacaggccgcctg

SEQ ID NO: 304 - DNA, 63 bp, Artificial Sequence
  /note="Description of Artificial Sequence: Synthetic primer"
agtcaggatcctcaagcgtaatctggaacatcgtatgggtacaggtgcagctcgtgggttttg

SEQ ID NO: 305 - DNA, 43 bp, Artificial Sequence
  /note="Description of Artificial Sequence: Synthetic primer"
agtcagctagcatgtctgataacggagaactggaagataagcc

SEQ ID NO: 306 - DNA, 69 bp, Artificial Sequence
  /note="Description of Artificial Sequence: Synthetic primer"
agtcaggatccttacttgtcgtcatcgtctttgtagtcacggttactcttcattgcttctttagctgcc

SEQ ID NO: 307 - DNA, 21 bp, Artificial Sequence
  /note="Description of Artificial Sequence: Synthetic primer"
gttggccgtgagggcatcatc

SEQ ID NO: 308 - DNA, 26 bp, Artificial Sequence
  /note="Description of Artificial Sequence: Synthetic primer"
cttgtttttggctttgtaccagttgg

SEQ ID NO: 309 - DNA, 23 bp, Artificial Sequence
  /note="Description of Artificial Sequence: Synthetic primer"
cgcctgagacaggcctgttcctg

SEQ ID NO: 310 - DNA, 25 bp, Artificial Sequence
  /note="Description of Artificial Sequence: Synthetic primer"
ggtacagaagccgctcagcctgctc

SEQ ID NO: 311 - DNA, 22 bp, Artificial Sequence
  /note="Description of Artificial Sequence: Synthetic primer"
cttgtgcagctcctgggcgtga

SEQ ID NO: 312 - DNA, 23 bp, Artificial Sequence
  /note="Description of Artificial Sequence: Synthetic primer"
gttgctatgccgcagttgcgtca

SEQ ID NO: 313 - DNA, 31 bp, Artificial Sequence
  /note="Description of Artificial Sequence: Synthetic primer"
aagttcttcgactccaacacagtgaagcaga

SEQ ID NO: 314 - DNA, 24 bp, Artificial Sequence
  /note="Description of Artificial Sequence: Synthetic primer"
taggacatccagcacagcctgagg

SEQ ID NO: 315 - DNA, 37 bp, Artificial Sequence
  /note="Description of Artificial Sequence: Synthetic primer"
cagaaatttctgagctttactcctcctgagaaagatg

SEQ ID NO: 316 - DNA, 33 bp, Artificial Sequence
  /note="Description of Artificial Sequence: Synthetic primer"
cttcactgtgttggagtcgtagaactttaggac

SEQ ID NO: 317 - DNA, 31 bp, Artificial Sequence
  /note="Description of Artificial Sequence: Synthetic primer"
tcaattttcacacggtctgtaattgaccctg

SEQ ID NO: 318 - DNA, 21 bp, Artificial Sequence
  /note="Description of Artificial Sequence: Synthetic primer"
tttcgtatgatccggtcgcgg

SEQ ID NO: 319 - DNA, 41 bp, Artificial Sequence
  /note="Description of Artificial Sequence: Synthetic primer"
aatggactatcatatgcttaccgtaacttgaaagtatttcg

SEQ ID NO: 320 - DNA, 48 bp, Artificial Sequence
  /note="Description of Artificial Sequence: Synthetic primer"
tctactattctttcccctgcactgtacctgtgggcgatgtgcgctctg

SEQ ID NO: 321 - DNA, 82 bp, Artificial Sequence
  /note="Description of Artificial Sequence: Synthetic primer"
aatgatacggcgaccaccgagatctacactctttccctacacgacgctcttccgatcttcttgtggaaaggacgaaacaccg

SEQ ID NO: 322 - DNA, 92 bp, Artificial Sequence
  /note="Description of Artificial Sequence: Synthetic primer"
  misc_feature (59)..(64): n is a, c, g, or t
caagcagaagacggcatacgagatgtgactggagttcagacgtgtgctcttccgatctnnnnnntctactattctttcccctgcactgtacc

SEQ ID NO: 323 - DNA, 36 bp, Artificial Sequence
  /note="Description of Artificial Sequence: Synthetic primer"
ctcttccgatcttcttgtggaaaggacgaaacaccg

SEQ ID NO: 324 - DNA, 39 bp, Artificial Sequence
  /note="Description of Artificial Sequence: Synthetic primer"
catcgcccacaggtacagtgcaggggaaagaatagtaga

SEQ ID NO: 325 - DNA, 23 bp, Artificial Sequence
  /note="Description of Artificial Sequence: Synthetic primer"
ggtgtgaaccatgagaagtatga

SEQ ID NO: 326 - DNA, 22 bp, Artificial Sequence
  /note="Description of Artificial Sequence: Synthetic primer"
gagtccttccacgataccaaag

SEQ ID NO: 327 - DNA, 22 bp, Artificial Sequence
  /note="Description of Artificial Sequence: Synthetic primer"
cggaatccttctctgggaaatc

SEQ ID NO: 328 - DNA, 22 bp, Artificial Sequence
  /note="Description of Artificial Sequence: Synthetic primer"
catccatcttgtagcccttctc

SEQ ID NO: 329 - protein, 5 aa, Artificial Sequence
  /note="Description of Artificial Sequence: Consensus binding motif"
  misc_feature (2)..(3): Xaa can be any naturally occurring amino acid
LXXLL

What is claimed is:

1. A method of treating a subject afflicted with a c-Src tyrosine kinase (CSK)-null breast cancer that is resistant to an endocrine therapy comprising administering to the subject a therapeutically effective amount of a small molecule inhibitor of PAK2 that directly binds PAK2, thereby treating the subject afflicted with the breast cancer that is resistant to the endocrine therapy.

2. The method of claim 1, wherein the small molecule inhibitor of PAK2 reduces the number of proliferating cells in the cancer reduces the volume or size of a tumor of the cancer.

3. The method of claim 1, wherein the small molecule inhibitor of PAK2 is administered in a pharmaceutically acceptable formulation.

4. The method of claim 1, wherein the small molecule inhibitor of PAK2 is FRAX597.

5. The method of claim 1, further comprising administering to the subject a therapeutic agent or regimen for treating the cancer.

6. The method of any one of claim 1-5, wherein the cancer is an estrogen receptor positive ($ER_+$) breast cancer.

7. The method of any one of claims 1-5, wherein the subject is an animal or mouse model of $ER_+$ breast cancer.

8. The method of any one of claims 1-5, wherein the subject is a mammal.

9. The method of claim 8, wherein the mammal is a mouse or a human.

10. The method of claim 6, wherein the subject is a mammal.

11. The method of claim 10, wherein the mammal is a mouse or a human.

* * * * *